(12) United States Patent
Agard et al.

(10) Patent No.: US 10,973,888 B2
(45) Date of Patent: *Apr. 13, 2021

(54) HUMAN ALPHA-GALACTOSIDASE VARIANTS

(71) Applicant: Codexis, Inc., Redwood City, CA (US)

(72) Inventors: Nicholas J. Agard, San Francisco, CA (US); Mathew G. Miller, San Carlos, CA (US); Xiyun Zhang, Fremont, CA (US); Gjalt W. Huisman, Redwood City, CA (US)

(73) Assignee: Codexis, Inc., Redwood City, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/985,742

(22) Filed: Aug. 5, 2020

(65) Prior Publication Data

US 2020/0360489 A1 Nov. 19, 2020

Related U.S. Application Data

(63) Continuation of application No. 15/529,383, filed as application No. PCT/US2015/063329 on Dec. 2, 2015.

(60) Provisional application No. 62/095,313, filed on Dec. 22, 2014, provisional application No. 62/216,452, filed on Sep. 10, 2015.

(51) Int. Cl.
*C12N 9/24* (2006.01)
*C12N 15/81* (2006.01)
*A61K 38/47* (2006.01)
*C12N 9/40* (2006.01)
*A61K 9/00* (2006.01)

(52) U.S. Cl.
CPC ............ *A61K 38/47* (2013.01); *A61K 9/0019* (2013.01); *C12N 9/2465* (2013.01); *C12Y 302/01022* (2013.01)

(58) Field of Classification Search
CPC .. C12N 9/2468; C12N 9/2451; C12Y 302/02; A61K 38/00
See application file for complete search history.

(56) References Cited

U.S. PATENT DOCUMENTS

| | | | |
|---|---|---|---|
| 5,356,804 A | 10/1994 | Desnick et al. | |
| 5,605,793 A | 2/1997 | Stemmer | |
| 5,811,238 A | 9/1998 | Stemmer et al. | |
| 5,830,721 A | 11/1998 | Stemmer et al. | |
| 5,834,252 A | 11/1998 | Stemmer et al. | |
| 5,837,458 A | 11/1998 | Minshull et al. | |
| 5,928,905 A | 7/1999 | Stemmer et al. | |
| 6,096,548 A | 8/2000 | Stemmer | |
| 6,117,679 A | 9/2000 | Stemmer | |
| 6,132,970 A | 10/2000 | Stemmer | |
| 6,165,793 A | 12/2000 | Stemmer | |
| 6,180,406 B1 | 1/2001 | Stemmer | |
| 6,251,674 B1 | 6/2001 | Tobin et al. | |
| 6,277,638 B1 | 8/2001 | Stemmer | |
| 6,287,861 B1 | 9/2001 | Stemmer et al. | |
| 6,287,862 B1 | 9/2001 | delCardayre et al. | |
| 6,291,242 B1 | 9/2001 | Stemmer | |
| 6,297,053 B1 | 10/2001 | Stemmer | |
| 6,303,344 B1 | 10/2001 | Patten et al. | |
| 6,309,883 B1 | 10/2001 | Minshull et al. | |
| 6,319,713 B1 | 11/2001 | Patten et al. | |
| 6,319,714 B1 | 11/2001 | Crameri et al. | |
| 6,323,030 B1 | 11/2001 | Stemmer | |
| 6,326,204 B1 | 12/2001 | delCardayre et al. | |
| 6,335,160 B1 | 1/2002 | Patten et al. | |
| 6,335,198 B1 | 1/2002 | delCardayre et al. | |
| 6,344,356 B1 | 2/2002 | Stemmer | |
| 6,352,859 B1 | 3/2002 | delCardayre et al. | |
| 6,355,484 B1 | 3/2002 | Patten et al. | |
| 6,358,740 B1 | 3/2002 | Patten et al. | |
| 6,358,742 B1 | 3/2002 | Stemmer | |
| 6,365,377 B1 | 4/2002 | Patten et al. | |
| 6,365,408 B1 | 4/2002 | Stemmer | |
| 6,368,861 B1 | 4/2002 | Crameri et al. | |
| 6,372,497 B1 | 4/2002 | Stemmer | |
| 6,376,246 B1 | 4/2002 | Crameri et al. | |
| 6,379,964 B1 | 4/2002 | delCardayre et al. | |
| 6,387,702 B1 | 5/2002 | Stemmer | |
| 6,391,552 B2 | 5/2002 | Stemmer | |
| 6,391,640 B1 | 5/2002 | Minshull et al. | |
| 6,395,547 B1 | 5/2002 | Stemmer | |
| 6,406,855 B1 | 6/2002 | Patten et al. | |
| 6,406,910 B1 | 6/2002 | Patten et al. | |
| 6,413,745 B1 | 7/2002 | Patten et al. | |
| 6,413,774 B1 | 7/2002 | Stemmer | |
| 6,420,175 B1 | 7/2002 | Stemmer | |
| 6,423,542 B1 | 7/2002 | Crameri et al. | |
| 6,426,224 B1 | 7/2002 | Crameri et al. | |
| 6,436,675 B1 | 8/2002 | Welch et al. | |
| 6,444,468 B1 | 9/2002 | Stemmer et al. | |
| 6,455,253 B1 | 9/2002 | Patten et al. | |
| 6,479,652 B1 | 11/2002 | Crameri et al. | |

(Continued)

OTHER PUBLICATIONS

Guce et al., JBC, 285(6), 3625-3632, 2010.*
GenBank Assession No. AAP36507.1 dated May 13, 2003.

*Primary Examiner* — Maryam Monshipouri
(74) *Attorney, Agent, or Firm* — Codexis, Inc.

(57) ABSTRACT

The present invention provides engineered human alpha-galactosidase polypeptides and compositions thereof. The engineered human alpha-galactosidase polypeptides have been optimized to provide improved stability under both acidic (pH<4.5) and basic (pH>7) conditions. The invention also relates to the use of the compositions comprising the engineered human alpha-galactosidase polypeptides for therapeutic purposes.

13 Claims, 5 Drawing Sheets

Specification includes a Sequence Listing.

(56) References Cited

U.S. PATENT DOCUMENTS

| | | |
|---|---|---|
| 6,482,647 B1 | 11/2002 | Stemmer |
| 6,489,146 B2 | 12/2002 | Stemmer et al. |
| 6,506,602 B1 | 1/2003 | Stemmer |
| 6,506,603 B1 | 1/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,613,514 B2 | 9/2003 | Patten et al. |
| 6,653,072 B1 | 11/2003 | Patten et al. |
| 6,716,631 B1 | 4/2004 | delCardayre et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,288,375 B2 | 10/2007 | Stemmer et al. |
| 7,421,347 B2 | 9/2008 | Selfinov et al. |
| 7,430,477 B2 | 9/2008 | Selfinov et al. |
| 7,531,341 B1 | 5/2009 | Vellard et al. |
| 7,534,564 B2 | 5/2009 | Patten et al. |
| 7,534,595 B2 | 5/2009 | Vellard et al. |
| 7,560,263 B2 | 7/2009 | Kakkis et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,833,742 B2 * | 11/2010 | Treco .................. A61P 7/00 435/14 |
| 7,853,410 B2 | 12/2010 | Selfinov et al. |
| 7,868,138 B2 | 1/2011 | Stemmer et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 8,383,346 B2 | 2/2013 | Colbeck et al. |
| 8,504,498 B2 | 8/2013 | Fox |
| 8,768,871 B2 | 7/2014 | Fox |
| 8,849,575 B2 | 9/2014 | Gustafsson et al. |
| 8,876,066 B1 | 11/2014 | Richards |
| 9,308,281 B2 | 4/2016 | Guild et al. |
| 2008/0220990 A1 | 9/2008 | Fox |
| 2009/0312196 A1 | 12/2009 | Colbeck et al. |
| 2011/0280856 A1 | 11/2011 | Selden et al. |
| 2012/0177722 A1 | 7/2012 | Weiner et al. |
| 2012/0328592 A1 | 12/2012 | Shulman et al. |
| 2013/0039898 A1 | 2/2013 | Okhamafe et al. |
| 2014/0005057 A1 | 1/2014 | Clark et al. |
| 2014/0214391 A1 | 7/2014 | Cope |
| 2014/0221216 A1 | 8/2014 | Cope et al. |
| 2015/0050658 A1 | 2/2015 | Cho |
| 2015/0133307 A1 | 5/2015 | Zhang et al. |
| 2015/0134315 A1 | 5/2015 | Sarmiento et al. |

* cited by examiner

A.  B.

A.

B.

A&B.

C&D.

A. B.

A.

B.

A.

B.

HUMAN ALPHA-GALACTOSIDASE VARIANTS

The present application is a Continuation application that claims priority to co-pending U.S. patent application Ser. No. 15/529,383, filed May 24, 2017, which is a national stage application filed under 35 USC § 371 and claims priority to PCT International Application No. PCT/US2015/063329, filed Dec. 2, 2015, which claims priority to U.S. Prov. Pat. Application Ser. No. 62/095,313, filed Dec. 22, 2014, and U.S. Prov. Pat. Application Ser. No. 62/216,452, filed Sep. 10, 2015, all of which are hereby incorporated by reference in their entireties for all purposes.

FIELD OF THE INVENTION

The present invention provides engineered human alpha-galactosidase polypeptides and compositions thereof. The engineered human alpha-galactosidase polypeptides have been optimized to provide improved stability under both acidic (pH<4.5) and basic (pH>7) conditions. The invention also relates to the use of the compositions comprising the engineered human alpha-galactosidase polypeptides for therapeutic purposes.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX7-147W02UC1_ST25.txt", a creation date of Aug. 4, 2020, and a size of 2,545,695 bytes. The Sequence Listing filed via EFS-Web is part of the specification and is incorporated in its entirety by reference herein.

BACKGROUND OF THE INVENTION

Human alpha galactosidase ("GLA"; EC 3.2.1.22) is a lysosomal glycoprotein responsible for hydrolyzing terminal alpha galactosyl moieties from glycolipids and glycoproteins. It works on many substrates present in a range of human tissues. Fabry disease (also referred to as angiokeratoma corporis diffusum, Anderson-Fabry disease, hereditary dystopic lipidosis, alpha-galactosidase A deficiency, GLA deficiency, and ceramide trihexosidase deficiency) is an X-linked inborn error of glycosphingolipid catabolism that results from deficient or absent activity of alpha-galactosidase A. Patients affected with Fabry disease accumulate globotriosylceramide ($Gb_3$) and related glycosphingolipids in the plasma and cellular lysosomes of blood vessels, tissue and organs (See e.g., Nance et al., Arch. Neurol., 63:453-457 [2006]). As the patient ages, the blood vessels become progressively narrowed, due to the accumulation of these lipids, resulting in decreased blood flow and nourishment to the tissues, particularly in the skin, kidneys, heart, brain, and nervous system. Thus, Fabry disease is a systemic disorder that manifests as renal failure, cardiac disease, cerebrovascular disease, small-fiber peripheral neuropathy, and skin lesions, as well as other disorders (See e.g., Schiffmann, Pharm. Ther., 122:65-77 [2009]). Affected patients exhibit symptoms such as painful hands and feet, clusters of small, dark red spots on their skin, the decreased ability to sweat, corneal opacity, gastrointestinal issues, tinnitus, and hearing loss. Potentially life-threatening complications include progressive renal damage, heart attacks, and stroke. This disease affects an estimated 1 in 40,000-60,000 males, but also occurs in females. Indeed, heterozygous women with Fabry disease experience significant life-threatening conditions requiring medical treatment, including nervous system abnormalities, chronic pain, fatigue, high blood pressure, heart disease, kidney failure, and stroke (See e.g., Want et al., Genet. Med., 13:457-484 [2011]). Signs of Fabry disease can start any time from infancy on, with signs usually beginning to show between ages 4 and 8, although some patients exhibit a milder, late-onset disease. Treatment is generally supportive and there is no cure for Fabry disease, thus there remains a need for a safe and effective treatment.

SUMMARY OF THE INVENTION

The present invention provides engineered human alpha-galactosidase polypeptides and compositions thereof. The engineered human alpha-galactosidase polypeptides have been optimized to provide improved stability under both acidic (pH<4.5) and basic (pH>7) conditions. The invention also relates to the use of the compositions comprising the engineered human alpha-galactosidase polypeptides for therapeutic purposes.

The present invention provides recombinant alpha galactosidase A and/or biologically active recombinant alpha galactosidase A fragment comprising an amino acid sequence comprising at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to SEQ ID NO:5. In some embodiments, the alpha galactosidase A comprises at least one mutation in at least one position as provided in Tables 2.1, 2.2, 2.4, and/or 2.5, wherein the positions are numbered with reference to SEQ ID NO:5. In some embodiments, the alpha galactosidase A comprises at least one mutation in at least one position as provided in Table 2.3, wherein the positions are numbered with reference to SEQ ID NO:10. In some additional embodiments, the recombinant alpha galactosidase A is derived from a human alpha galactosidase A. In some further embodiments, the recombinant alpha galactosidase A comprises the polypeptide sequence of SEQ ID NO:15, 13, 10, or 18. In still some additional embodiments, the recombinant alpha galactosidase A is more thermostable than the alpha galactosidase A of SEQ ID NO:5. In some further embodiments, the recombinant alpha galactosidase A is more stable at pH 7.4 than the alpha galactosidase A of SEQ ID NO:5, while in additional embodiments, the recombinant alpha galactosidase A is more stable at pH 4.3 than the alpha galactosidase A of SEQ ID NO:5. In some embodiments the recombinant alpha galactosidase A is more stable at pH 7.4 and pH 4.3 than the alpha galactosidase A of SEQ ID NO:5. In still some further embodiments, the recombinant alpha galactosidase A is a deimmunized alpha galactosidase A. In some embodiments, the recombinant alpha galactosidase A is a deimmunized alpha galactosidase A provided in Table 7.1. In still some additional embodiments, the recombinant alpha galactosidase A is purified. In some embodiments, the recombinant alpha galactosidase A exhibits at least one improved property selected from: i) enhanced catalytic activity; ii) increased tolerance to pH 7.4; iii) increased tolerance to pH 4.3; or iv) reduced immunogenicity; or a combination of any of i), ii), iii), or iv), as compared to a reference sequence. In some embodiments, the reference sequence is SEQ ID NO:5, while in some alternative embodiments, the reference sequence is SEQ ID NO:10.

The present invention also provides recombinant polynucleotide sequences encoding at least one recombinant alpha galactosidase A as provided herein (e.g., Tables 2.1, 2.2, 2.3, 2.4, 2.5, and/or Table 7.1). In some embodiments, the recombinant polynucleotide sequence is codon-optimized.

The present invention also provides expression vectors comprising the recombinant polynucleotide sequence encoding at least one recombinant alpha galactosidase A as provided herein (e.g., Tables 2.1, 2.2, 2.3, 2.4, 2.5, and/or Table 7.1). In some embodiments, the recombinant polynucleotide sequence is operably linked to a control sequence. In some additional embodiments, the control sequence is a promoter. In some further embodiments, the promoter is a heterologous promoter. In some embodiments, the expression vector further comprises a signal sequence, as provided herein.

The present invention also provides host cells comprising at least one expression vector as provided herein. In some embodiments, the host cell comprises an expression vector comprising the recombinant polynucleotide sequence encoding at least one recombinant alpha galactosidase A as provided herein (e.g., Tables 2.1, 2.2, 2.3, 2.4, 2.5, and/or Table 7.1). In some embodiments, the host cell is eukaryotic.

The present invention also provides methods of producing an alpha galactosidase A variant, comprising culturing a host cell provided herein, under conditions that the alpha galactosidase A encoded by the recombinant polynucleotide is produced. In some embodiments, the methods further comprise the step of recovering alpha galactosidase A. In some further embodiments, the methods further comprise the step of purifying the alpha galactosidase A.

The present invention also provides compositions comprising at least one recombinant alpha galactosidase A as provided herein (e.g., Tables 2.1, 2.2, 2.3, 2.4, 2.5, and/or Table 7.1). In some embodiments, the present invention provides pharmaceutical compositions. In some additional embodiments, the present invention provides pharmaceutical compositions for the treatment of Fabry disease, comprising an enzyme composition provided herein. In some embodiments, the pharmaceutical compositions, further comprise a pharmaceutically acceptable carrier and/or excipient. In some additional embodiments, the pharmaceutical composition is suitable for parenteral injection or infusion to a human.

The present invention also provides methods for treating and/or preventing the symptoms of Fabry disease in a subject, comprising providing a subject having Fabry disease, and providing at least one pharmaceutical composition compositions comprising at least one recombinant alpha galactosidase A as provided herein (e.g., Tables 2.1, 2.2, 2.3, 2.4, 2.5, and/or Table 7.1), and administering the pharmaceutical composition to the subject. In some embodiments, the symptoms of Fabry disease are ameliorated in the subject. In some additional embodiments, the subject to whom the pharmaceutical composition of the present invention has been administered is able to eat a diet that is less restricted in its fat content than diets required by subjects exhibiting the symptoms of Fabry disease. In some embodiments, the subject is an infant or child, while in some alternative embodiments, the subject is an adult or young adult.

The present invention also provides for the use of the compositions provided herein.

DESCRIPTION OF THE INVENTION

Figure 1:
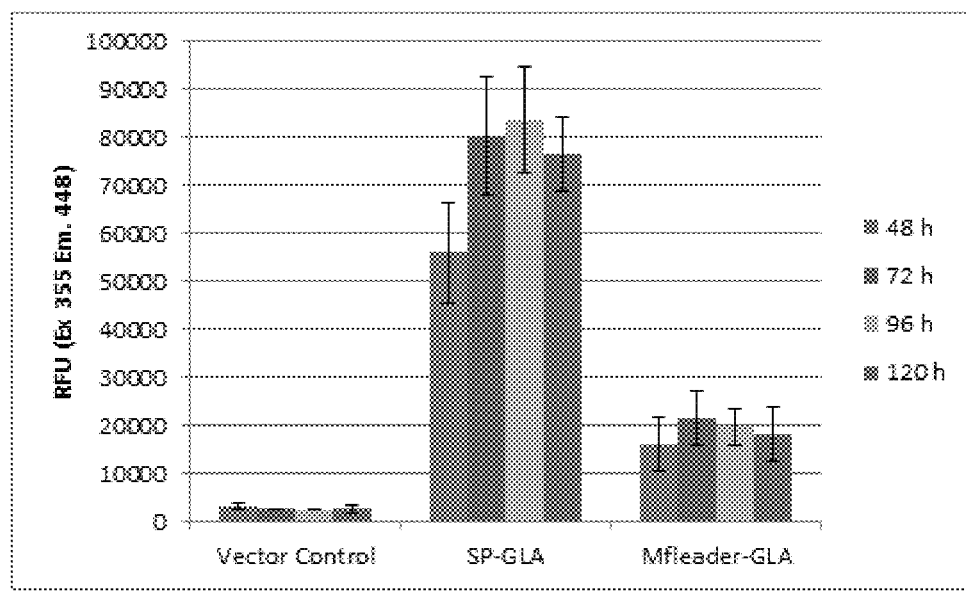
FIG. 1 provides a graph showing the relative activity of different GLA constructs in *S. cerevisiae* after 2-5 days of culturing.

The present invention provides engineered human alpha-galactosidase polypeptides and compositions thereof. The engineered human alpha-galactosidase polypeptides have been optimized to provide improved stability under both acidic (pH<4.5) and basic (pH>7) conditions. The invention also relates to the use of the compositions comprising the engineered human alpha-galactosidase polypeptides for therapeutic purposes.

In some embodiments, the engineered human alpha-galactosidase polypeptides have been optimized to provide improved stability at various levels. The invention also relates to the use of the compositions comprising the engineered human alpha-galactosidase polypeptides for therapeutic purposes.

Enzyme replacement therapy for treatment of Fabry disease (e.g., Fabrazyme® agalsidase beta; Genzyme) is available and is considered for eligible individuals. Currently used enzyme replacements therapies are recombinantly expressed forms of the wild-type human GLA. It is known that intravenously administered GLA circulates, becomes endocytosed, and travels to the endosomes/lysosomes of target organs, where it reduces the accumulation of Gb3. These drugs do not completely relieve patient symptoms, as neuropathic pain and transient ischemic attacks continue to occur at reduced rates. In addition, the uptake of GLA by most target organs is poor in comparison to the liver, and the enzyme is unstable at the pH of blood and lysosomes. Thus, issues remain with available treatments. In addition, patients may develop an immune response (IgG and IgE antibodies targeting the administered drug), and suffer severe allergic (anaphylactic) reactions, severe infusion reactions, and even death. The present invention is intended to provide more stable enzymes suitable for treatment of Fabry disease, yet with reduced side effects and improved outcomes, as compared to currently available treatments. Indeed, the present invention is intended to provide recombinant GLA enzymes that have increased stability in blood (pH 7.4), which the enzyme encounters upon injection into the bloodstream. In addition, the enzyme has increased stability at the pH of the lysosome (pH 4.3), the location where the enzyme is active during therapy. Thus, directed evolution of recombinantly expressed human GLA in *Saccharomyces cerevisiae*, employing high throughput screening of diverse enzyme variant libraries, was used to provide novel GLA variants with desired stability properties. In addition, variant enzymes were screened and their amino acid sequence determined in order to identify novel GLA variants with a predicted reduced immunogenicity. By providing GLA variants with increased pH stability and reduced immunogenicity, the present invention provides compositions and methods suitable for use in patients by increasing patient tolerance of treatment and providing flexibility in dosing and formulation for improved patient outcomes.

Abbreviations and Definitions

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, biochemistry, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the application as a whole. All patents, patent applications, articles and publications mentioned herein, both supra and infra, are hereby expressly incorporated herein by reference.

Also, as used herein, the singular "a", "an," and "the" include the plural references, unless the context clearly indicates otherwise.

Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

The term "about" means an acceptable error for a particular value. In some instances "about" means within 0.05%, 0.5%, 1.0%, or 2.0%, of a given value range. In some instances, "about" means within 1, 2, 3, or 4 standard deviations of a given value.

Furthermore, the headings provided herein are not limitations of the various aspects or embodiments of the invention which can be had by reference to the application as a whole. Accordingly, the terms defined immediately below are more fully defined by reference to the application as a whole. Nonetheless, in order to facilitate understanding of the invention, a number of terms are defined below.

Unless otherwise indicated, nucleic acids are written left to right in 5' to 3' orientation; amino acid sequences are written left to right in amino to carboxy orientation, respectively.

As used herein, the term "comprising" and its cognates are used in their inclusive sense (i.e., equivalent to the term "including" and its corresponding cognates).

"EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

"ATCC" refers to the American Type Culture Collection whose biorepository collection includes genes and strains.

"NCBI" refers to National Center for Biological Information and the sequence databases provided therein.

"Protein," "polypeptide," and "peptide" are used interchangeably herein to denote a polymer of at least two amino acids covalently linked by an amide bond, regardless of length or post-translational modification (e.g., glycosylation or phosphorylation).

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

The term "engineered," "recombinant," "non-naturally occurring," and "variant," when used with reference to a cell, a polynucleotide or a polypeptide refers to a material or a material corresponding to the natural or native form of the material that has been modified in a manner that would not otherwise exist in nature or is identical thereto but produced or derived from synthetic materials and/or by manipulation using recombinant techniques.

As used herein, "wild-type" and "naturally-occurring" refer to the form found in nature. For example a wild-type polypeptide or polynucleotide sequence is a sequence present in an organism that can be isolated from a source in nature and which has not been intentionally modified by human manipulation.

"Deimmunized" as used herein, refers to the manipulation of a protein sequence to create a variant that is predicted to be not as immunogenic as the wild-type or reference protein. In some embodiments, the predicted deimmunization is complete, in that the variant protein is predicted to not stimulate an immune response in patients to whom the variant protein is administered. This response can be measured by various methods including but not limited to, the presence or abundance of anti-drug antibodies, the presence or abundance of neutralizing antibodies, the presence of an anaphylactic response, peptide presentation on major histocompatibility complex-II (MHC-II) proteins, or the prevalence or intensity of cytokine release upon administration of the protein. In some embodiments, the variant protein is less immunogenic than the wild-type or reference protein. In some embodiments, deimmunization involves modifications to subsequences of proteins (e.g., epitopes) that are recognized by human leukocyte antigen (HLA) receptors. In some embodiments, these epitopes are removed by changing their amino acid sequences to produce a deimmunized variant protein in which such subsequences are no longer recognized by the HLA receptors. In some other embodiments, these epitopes retain binding affinity to HLA receptors, but are not presented. In some embodiments, the deimmunized protein shows lower levels of response in biochemical and cell-biological predictors of human immunological responses including dendritic-cell T-cell activation assays, or (HLA) peptide binding assays. In some embodiments, these epitopes are removed by changing their amino acid sequence to produce a deimmunized variant protein in which the epitopes are no longer recognized by T-cell receptors. In still other embodiments the deimmunized protein induces anergy in its corresponding T-cells, activates T regulatory cells, or results in clonal deletion of recognizing B-cells.

"Coding sequence" refers to that part of a nucleic acid (e.g., a gene) that encodes an amino acid sequence of a protein.

The term "percent (%) sequence identity" is used herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See, Altschul et al., J. Mol. Biol., 215: 403-410 [1990]; and Altschul et al., 1977, Nucleic Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. "Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered GLA, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X93 as compared to SEQ ID NO:2" refers to a difference of the amino acid residue at the polypeptide position corresponding to position 93 of SEQ ID NO:2. Thus, if the reference polypeptide of SEQ ID NO:2 has a serine at position 93, then a "residue difference at position X93 as compared to SEQ ID NO:2" an amino acid substitution of any residue other than serine at the position of the polypeptide corresponding to position 93 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Tables 2.1, 2.2, 2.3, 2.4, 2.5, and 6.1), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X307H/X307P or X307H/P). In some embodiments, the enzyme variants comprise more than one substitution. These substitutions are separated by a slash for ease in reading (e.g., C143A/K206A). The present application includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid (e.g., alanine, valine, leucine, and isoleucine); an amino acid with hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

A "functional fragment" or a "biologically active fragment" used interchangeably herein refers to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered GLA of the present invention) and that retains substantially all of the activity of the full-length polypeptide.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The recombinant GLA polypeptides may be present within a cell, present in the cellular medium, or prepared in various forms, such as lysates or isolated preparations. As such, in some embodiments, the recombinant GLA polypeptides can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure GLA composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant GLA polypeptides are substantially pure polypeptide compositions.

"Improved enzyme property" refers to an engineered GLA polypeptide that exhibits an improvement in any enzyme property as compared to a reference GLA polypeptide and/or as a wild-type GLA polypeptide or another engineered GLA polypeptide. Improved properties include but are not limited to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic or basic pH, increased tolerance to proteolytic activity (i.e., reduced sensitivity to proteolysis), reduced aggregation, increased solubility, reduced immunogenicity, improved post-translational modification (e.g., glycosylation), and altered temperature profile.

"Increased enzymatic activity" or "enhanced catalytic activity" refers to an improved property of the engineered GLA polypeptides, which can be represented by an increase in specific activity (e.g., product produced/time/weight protein) or an increase in percent conversion of the substrate to the product (e.g., percent conversion of starting amount of substrate to product in a specified time period using a specified amount of GLA) as compared to the reference GLA enzyme. Exemplary methods to determine enzyme activity are provided in the Examples. Any property relating to enzyme activity may be affected, including the classical enzyme properties of $K_m$, $V_{max}$, or $k_{cat}$, changes of which can lead to increased enzymatic activity. Improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring GLA or another engineered GLA from which the GLA polypeptides were derived.

In some embodiments, the engineered GLA polypeptides have a $k_{cat}$ of at least 0.1/sec, at least 0.5/sec, at least 1.0/sec, at least 5.0/sec, at least 10.0/sec and in some preferred embodiments greater than 10.0/sec. In some embodiments, the $K_m$ is in the range of about 1 μM to about 5 mM; in the range of about 5 μM to about 2 mM; in the range of about 10 μM to about 2 mM; or in the range of about 10 μM to about 1 mM. In some specific embodiments, the engineered GLA enzyme exhibits improved enzymatic activity after exposure to certain conditions in the range of 1.5 to 10 fold, 1.5 to 25 fold, 1.5 to 50 fold, 1.5 to 100 fold or greater than that of a reference GLA enzyme (e.g., a wild-type GLA or any other reference GLA). GLA activity can be measured by any suitable method known in the art (e.g., standard assays, such as monitoring changes in spectrophotometric properties of reactants or products). In some embodiments, the amount of products produced can be measured by High-Performance Liquid Chromatography (HPLC) separation combined with UV absorbance or fluorescent detection directly or following o-phthaldialdehyde (OPA) derivatization. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

The term "improved tolerance to acidic pH" means that a recombinant GLA according to the invention will have increased stability (higher retained activity at about pH 4.8 after exposure to acidic pH for a specified period of time (1 hour, up to 24 hours)) as compared to a reference GLA or another enzyme.

"Physiological pH" as used herein means the pH range generally found in a subject's (e.g., human) blood.

The term "basic pH" (e.g., used with reference to improved stability to basic pH conditions or increased tolerance to basic pH) means a pH range of about 7 to 11.

The term "acidic pH" (e.g., used with reference to improved stability to acidic pH conditions or increased tolerance to acidic pH) means a pH range of about 1.5 to 4.5.

"Conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a GLA polypeptide can be expressed as "percent conversion" of the substrate to the product in a specific period of time.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018 M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest.

Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the GLA enzymes may be codon optimized for optimal production from the host organism selected for expression.

"Control sequence" refers herein to include all components, which are necessary or advantageous for the expression of a polynucleotide and/or polypeptide of the present application. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refers to those conditions in the enzymatic conversion reaction solution (e.g., ranges of enzyme loading, substrate loading, temperature, pH, buffers, co-solvents, etc.) under which a GLA polypeptide of the present application is capable of converting a substrate to the desired product compound, Exemplary "suitable reaction conditions" are provided in the present application and illustrated by the Examples. "Loading", such as in "compound loading" or "enzyme loading" refers to the concentration or amount of a component in a reaction mixture at the start of the reaction. "Substrate" in the context of an enzymatic conversion reaction process refers to the compound or molecule acted on by the GLA polypeptide. "Product" in the context of an enzymatic conversion process refers to the compound or molecule resulting from the action of the GLA polypeptide on a substrate.

As used herein the term "culturing" refers to the growing of a population of microbial cells under any suitable conditions (e.g., using a liquid, gel or solid medium).

Recombinant polypeptides can be produced using any suitable methods known the art. Genes encoding the wild-type polypeptide of interest can be cloned in vectors, such as plasmids, and expressed in desired hosts, such as *E. coli, S. cerevisiae*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Non-limiting examples of methods used for DNA and protein engineering are provided in the following patents: U.S. Pat. Nos. 6,117,679; 6,420,175; 6,376,246; 6,586,182; 7,747,391; 7,747,393; 7,783,428; and 8,383,346. After the variants are produced, they can be screened for any desired property (e.g., high or increased activity, or low or reduced activity, increased thermal activity, increased thermal stability, and/or acidic pH stability, etc.). In some embodiments, "recombinant GLA polypeptides" (also referred to herein as "engineered GLA polypeptides," "variant GLA enzymes," and "GLA variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature.

As used herein, the terms "host cell" and "host strain" refer to suitable hosts for expression vectors comprising DNA provided herein (e.g., the polynucleotides encoding the GLA variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues mean polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "therapeutic" refers to a compound administered to a subject who shows signs or symptoms of pathology having beneficial or desirable medical effects.

The term "pharmaceutical composition" refers to a composition suitable for pharmaceutical use in a mammalian subject (e.g., human) comprising a pharmaceutically effective amount of an engineered GLA polypeptide encompassed by the invention and an acceptable carrier.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

The term "subject" encompasses mammals such as humans, non-human primates, livestock, companion animals, and laboratory animals (e.g., rodents and lagamorphs). It is intended that the term encompass females as well as males.

As used herein, the term "patient" means any subject that is being assessed for, treated for, or is experiencing disease.

The term "infant" refers to a child in the period of the first month after birth to approximately one (1) year of age. As used herein, the term "newborn" refers to child in the period from birth to the 28$^{th}$ day of life. The term "premature infant" refers to an infant born after the twentieth completed week of gestation, yet before full term, generally weighing ~500 to ~2499 grams at birth. A "very low birth weight infant" is an infant weighing less than 1500 g at birth.

As used herein, the term "child" refers to a person who has not attained the legal age for consent to treatment or research procedures. In some embodiments, the term refers to a person between the time of birth and adolescence.

As used herein, the term "adult" refers to a person who has attained legal age for the relevant jurisdiction (e.g., 18 years of age in the United States). In some embodiments, the term refers to any fully grown, mature organism. In some embodiments, the term "young adult" refers to a person less than 18 years of age, but who has reached sexual maturity.

As used herein, "composition" and "formulation" encompass products comprising at least one engineered GLA of the present invention, intended for any suitable use (e.g., pharmaceutical compositions, dietary/nutritional supplements, feed, etc.).

The terms "administration" and "administering" a composition mean providing a composition of the present invention to a subject (e.g., to a person suffering from the effects of Fabry disease).

The term "carrier" when used in reference to a pharmaceutical composition means any of the standard pharmaceutical carrier, buffers, and excipients, such as stabilizers, preservatives, and adjuvants.

The term "pharmaceutically acceptable" means a material that can be administered to a subject without causing any undesirable biological effects or interacting in a deleterious manner with any of the components in which it is contained and that possesses the desired biological activity.

As used herein, the term "excipient" refers to any pharmaceutically acceptable additive, carrier, diluent, adjuvant, or other ingredient, other than the active pharmaceutical ingredient (API; e.g., the engineered GLA polypeptides of the present invention). Excipients are typically included for formulation and/or administration purposes.

The term "therapeutically effective amount" when used in reference to symptoms of disease/condition refers to the amount and/or concentration of a compound (e.g., engineered GLA polypeptides) that ameliorates, attenuates, or eliminates one or more symptom of a disease/condition or prevents or delays the onset of symptom(s).

The term "therapeutically effective amount" when used in reference to a disease/condition refers to the amount and/or concentration of a composition (e.g., engineered GLA polypeptides) that ameliorates, attenuates, or eliminates the disease/condition. In some embodiments, the term is use in reference to the amount of a composition that elicits the biological (e.g., medical) response by a tissue, system, or animal subject that is sought by the researcher, physician, veterinarian, or other clinician.

It is intended that the terms "treating," "treat" and "treatment" encompass preventative (e.g., prophylactic), as well as palliative treatment.

Engineered GLA Expression and Activity:

Two strategies for secreted GLA expression were utilized, using the yeast MFα signal peptide (MF-SP) or a longer leader sequence of 83 amino acids (MF-leader) to drive secretion of a yeast codon-optimized mature human GLA. Clones were expressed from a pYT-72 vector in S. cerevisiae strain INVSc1. Both approaches provided supernatants with measurable activity on the fluorogenic substrate 4-methylumbelliferyl α-D-galactopyranoside (4-MuGal). However, the construct with the yeast MFα signal peptide provided 3-fold higher activities and was used as the starting sequence for directed evolution.

To identify mutational diversity, a 13-position conserved "homolog" combinatorial library and a 192-position site saturation mutagenesis library were constructed. Equivalent volumes of supernatant were screened in an unchallenged condition (no incubation, pH 4.8) or following a one-hour incubation in a low pH (3.9-4.2) or high pH (7.1-8.2) environment. GLA variants with increased activity due to increased GLA expression or GLA specific activity were identified based on their fold improvement over the parent GLA. GLA variants with increased stability were identified by dividing the fold-improvement observed under challenged conditions by the fold-improvement observed under unchallenged conditions. This approach reduces the bias towards selecting variants based on increased expression but without changes in specific activity at pH extremes. Composite activity scores (the product of fold-improvements for all three conditions) and stability (the product of stability scores) were used to rank mutations in improved variants for inclusion in subsequent GLA libraries.

Engineered GLA:

In some embodiments the engineered GLA which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO:5, and an amino acid residue difference as compared to SEQ ID NO:5, at one or more amino acid positions (such as at 1, 2, 3, 4, 5, 6, 7, 8, 9, 10, 11, 12, 14, 15, 20 or more amino acid positions compared to SEQ ID NO:5, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO:5). In some embodiment the residue difference as compared to SEQ ID NO:5, at one or more positions will include at least 1, 2, 3, 4, 5, 6, 7, 8, 9, 10 or more conservative amino acid substitutions. In some embodiments, the engineered GLA polypeptide is a polypeptide listed in Table 2.1, 2.2, 2.4, 2.5, or Table 7.1.

In some embodiments the engineered GLA which exhibits an improved property has at least about 85%, at least about 88%, at least about 90%, at least about 91%, at least about 92%, at least about 93%, at least about 94%, at least about 95%, at least about 96%, at least about 97%, at least about 98%, at least about 99%, or at about 100% amino acid sequence identity with SEQ ID NO:10, and an amino acid residue difference as compared to SEQ ID NO:10, at one or more amino acid positions (such as at 1, 2, 3, 4, 5, 6, 7, 8, 9, 10, 11, 12, 14, 15, 20 or more amino acid positions compared to SEQ ID NO:10, or a sequence having at least 85%, at least 88%, at least 90%, at least 91%, at least 92%, at least 93%, at least 94%, at least 95%, at least 96%, at least 97%, at least 98%, at least 99% or greater amino acid sequence identity with SEQ ID NO:10). In some embodiment the residue difference as compared to SEQ ID NO:10, at one or more positions will include at least 1, 2, 3, 4, 5, 6, 7, 8, 9, 10 or more conservative amino acid substitutions. In some embodiments, the engineered GLA polypeptide is a polypeptide listed in Table 2.3.

In some embodiments the engineered GLA which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO:5. In some embodiments the engineered GLA which exhibits an improved property has at least 85%, at least 88%, at least 90%, at least 91%, at least 92%, at least 93%, at least 94%, at least 95%, at least 96%, at least 97%, at least 98%, or at least 99% amino acid sequence identity with SEQ ID NO:10.

In some embodiments, the engineered GLA polypeptide is selected from SEQ ID NOS:15, 13, 10, and 18.

In some embodiments, the engineered GLA polypeptide comprises a functional fragment of an engineered GLA polypeptide encompassed by the invention. Functional fragments have at least 80%, 81%, 82%, 83%, 84%, 85%, 86%, 87%, 88%, 89%, 90%, 91%, 92%, 93%, 94%, 95%, 96%, 97%, 98%, or 99% of the activity of the engineered GLA polypeptide from which is was derived (i.e., the parent engineered GLA). A functional fragment comprises at least 80%, 81%, 82%, 83%, 84%, 85%, 86%, 87%, 88%, 89%, 90%, 91%, 92%, 93%, 94%, 95%, 96%, 97%, 98% and even 99% of the parent sequence of the engineered GLA. In some embodiments the functional fragment is truncated by less than 5, less than 10, less than 15, less than 10, less than 25, less than 30, less than 35, less than 40, less than 45, and less than 50 amino acids.

Polynucleotides Encoding Engineered Polypeptides, Expression Vectors and Host Cells:

The present invention provides polynucleotides encoding the engineered GLA polypeptides described herein. In some embodiments, the polynucleotides are operatively linked to one or more heterologous regulatory sequences that control gene expression to create a recombinant polynucleotide capable of expressing the polypeptide. Expression constructs containing a heterologous polynucleotide encoding the engineered GLA polypeptides can be introduced into appropriate host cells to express the corresponding GLA polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the engineered GLA polypeptide. Thus, having knowledge of a particular amino acid sequence, those skilled in the art could make any number of different nucleic acids by simply modifying the sequence of one or more codons in a way which does not change the amino acid sequence of the protein. In this regard, the present invention specifically contemplates each and every possible variation of polynucleotides that could be made encoding the polypeptides described herein by selecting combinations based on the possible codon choices, and all such variations are to be considered specifically disclosed for any polypeptide described herein, including the variants provided in Tables 2.1, 2.2, 2.3, 2.4, 2.5, and 6.1.

In various embodiments, the codons are preferably selected to fit the host cell in which the protein is being produced. For example, preferred codons used in bacteria are used for expression in bacteria. Consequently, codon optimized polynucleotides encoding the engineered GLA polypeptides contain preferred codons at about 40%, 50%, 60%, 70%, 80%, or greater than 90% of codon positions of the full length coding region.

In some embodiments, as described above, the polynucleotide encodes an engineered polypeptide having GLA activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more identity to a reference sequence selected from SEQ ID NOS:5, and/or 10, or the amino acid sequence of any variant as disclosed in Tables 2.1, 2.2, 2.3, 2.4, 2.5, or 6.1, and one or more residue differences as compared to the reference polypeptide of SEQ ID NOS:5, and/or 10, or the amino acid sequence of any variant as disclosed in Tables 2.1, 2.2, 2.3, 2.4, 2.5, or 6.1, (for example 1, 2, 3, 4, 5, 6, 7, 8, 9, 10 or more amino acid residue positions). In some embodiments, the reference sequence is selected from SEQ ID NO:5 and/or 10. In some embodiments, the polynucleotide encodes an engineered polypeptide having GLA activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO:5, and one or more residue differences as compared to SEQ ID NO:5, at residue positions selected from those provided in Tables 2.1, 2.2, 2.4, 2.5, or 6.1, when optimally aligned with the polypeptide of SEQ ID NO:5.

In some embodiments, the polynucleotide encodes an engineered polypeptide having GLA activity with the properties disclosed herein, wherein the polypeptide comprises an amino acid sequence having at least 80%, 81%, 82%, 83%, 84%, 85%, 86%, 87%, 88%, 89%, 90%, 91%, 92%, 93%, 94%, 95%, 96%, 97%, 98%, 99% or more sequence identity to reference sequence SEQ ID NO:10, and one or more residue differences as compared to SEQ ID NO:10, at residue positions selected from those provided in Tables 2.3, when optimally aligned with the polypeptide of SEQ ID NO:10.

In some embodiments, the polynucleotide encoding the engineered GLA polypeptides comprises a polynucleotide sequence selected from a polynucleotide sequence encoding SEQ ID NOS:10, 13, 15, 18, 21, and 24. In some embodiments, the polynucleotide encoding an engineered GLA polypeptide has at least 80%, 81%, 82%, 83%, 84%, 85%, 86%, 87%, 88%, 89%, 90%, 93%, 95%, 96%, 97%, 98%, 99% nucleotide residue identity to SEQ ID NOS: 8, 9, 11, 12, 14, 16, 17, 19, 20, 22, and/or 23. In some embodiments, the polynucleotide encoding the engineered GLA polypeptides comprises a polynucleotide sequence selected from SEQ ID NOS:8, 9, 11, 12, 14, 16, 17, 19, 20, 22, and 23.

In some embodiments, the polynucleotides are capable of hybridizing under highly stringent conditions to a reference polynucleotide sequence selected from SEQ ID NOS: 8, 9, 11, 12, 14, 16, 17, 19, 20, 22, and 23, or a complement thereof, or a polynucleotide sequence encoding any of the variant GLA polypeptides provided herein. In some embodiments, the polynucleotide capable of hybridizing under highly stringent conditions encodes a GLA polypeptide comprising an amino acid sequence that has one or more residue differences as compared to SEQ ID NO:5 and/or 10, at residue positions selected from any positions as set forth in Tables 2.1, 2.2, 2.3, 2.4, 2.5, and/or 6.1.

In some embodiments, an isolated polynucleotide encoding any of the engineered GLA polypeptides provided herein is manipulated in a variety of ways to provide for expression of the polypeptide. In some embodiments, the polynucleotides encoding the polypeptides are provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

In some embodiments, the control sequences include among other sequences, promoters, leader sequences, polyadenylation sequences, propeptide sequences, signal peptide sequences, and transcription terminators. As known in the art, suitable promoters can be selected based on the host cells used. Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are known in the art (See e.g., Romanos et al., Yeast 8:423-488 [1992]). Exemplary promoters for use in mammalian cells include, but are not limited to those from cytomegalovirus (CMV), Simian vacuolating virus 40 (SV40), from *Homo sapiens* phosphorglycerate kinase, beta actin, elongation factor-1a or glyceraldehyde-3-phosphate dehydrogenase, or from *Gallus gallus*' β-actin.

In some embodiments, the control sequence is a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice finds use in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra). Exemplary terminators for mammalian cells include, but are not limited to those from cytomegalovirus (CMV), Simian vacuolating virus 40 (SV40), or from *Homo sapiens* growth hormone.

In some embodiments, the control sequence is a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells include, but are not limited to those from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are also known in the art (See e.g., Guo and Sherman, Mol. Cell. Bio., 15:5983-5990 [1995]).

In some embodiments, the control sequence is a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region that directs the expressed polypeptide into the secretory pathway of a host cell of choice finds use for expression of the engineered GLA polypeptides provided herein. Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase. Useful signal peptides for mammalian host cells include but are not limited to those from the genes for immunoglobulin gamma (IgG).

In some embodiments, the control sequence is a propeptide coding region that codes for an amino acid sequence positioned at the amino terminus of a polypeptide. The resultant polypeptide is referred to as a "proenzyme," "propolypeptide," or "zymogen," in some cases). A propolypeptide can be converted to a mature active polypeptide by catalytic or autocatalytic cleavage of the propeptide from the propolypeptide.

In another aspect, the present invention also provides a recombinant expression vector comprising a polynucleotide encoding an engineered GLA polypeptide, and one or more expression regulating regions such as a promoter and a terminator, a replication origin, etc., depending on the type of hosts into which they are to be introduced. in some embodiments, the various nucleic acid and control sequences described above are joined together to produce a recombinant expression vector which includes one or more convenient restriction sites to allow for insertion or substitution of the nucleic acid sequence encoding the variant GLA polypeptide at such sites. Alternatively, the polynucleotide sequence(s) of the present invention are expressed by inserting the polynucleotide sequence or a nucleic acid construct comprising the polynucleotide sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), that can be conveniently subjected to recombinant DNA procedures and can result in the expression of the variant GLA polynucleotide sequence. The choice of the vector will typically depend on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

In some embodiments, the expression vector preferably contains one or more selectable markers, which permit easy selection of transformed cells. A "selectable marker" is a gene the product of which provides for biocide or viral resistance, resistance to heavy metals, prototrophy to auxotrophs, and the like. Suitable markers for yeast host cells include, but are not limited to ADE2, HIS3, LEU2, LYS2, MET3, TRP1, and URA3. Selectable markers for use in a filamentous fungal host cell include, but are not limited to, amdS (acetamidase), argB (ornithine carbamoyltransferases), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. In another aspect, the present invention provides a host cell comprising a polynucleotide encoding at least one engineered GLA polypeptide of the present application, the polynucleotide being operatively linked to one or more control sequences for expression of the engineered GLA enzyme(s) in the host cell. Host cells for use in expressing the polypeptides encoded by the expression vectors of the present invention are well known in the art and include but are not limited to, fungal cells, such as yeast cells (e.g., *Saccharomyces cerevisiae* and *Pichia pastoris* [e.g., ATCC Accession No. 201178]); insect cells (e.g., *Drosophila* S2 and *Spodoptera* Sf9 cells), plant cells, animal cells (e.g., CHO, COS, and BHK), and human cells (e.g., HEK293T, human fibroblast, THP-1, Jurkat and Bowes melanoma cell lines).

Accordingly, in another aspect, the present invention provides methods for producing the engineered GLA polypeptides, where the methods comprise culturing a host cell capable of expressing a polynucleotide encoding the engineered GLA polypeptide under conditions suitable for expression of the polypeptide. In some embodiments, the methods further comprise the steps of isolating and/or purifying the GLA polypeptides, as described herein.

Appropriate culture media and growth conditions for the above-described host cells are well known in the art. Polynucleotides for expression of the GLA polypeptides may be introduced into cells by various methods known in the art. Techniques include, among others, electroporation, biolistic particle bombardment, liposome mediated transfection, calcium chloride transfection, and protoplast fusion.

The engineered GLA with the properties disclosed herein can be obtained by subjecting the polynucleotide encoding the naturally occurring or engineered GLA polypeptide to mutagenesis and/or directed evolution methods known in the art, and as described herein. An exemplary directed evolution technique is mutagenesis and/or DNA shuffling (See e.g., Stemmer, Proc. Natl. Acad. Sci. USA 91:10747-10751 [1994]; WO 95/22625; WO 97/0078; WO 97/35966; WO 98/27230; WO 00/42651; WO 01/75767 and U.S. Pat. No. 6,537,746). Other directed evolution procedures that can be used include, among others, staggered extension process (StEP), in vitro recombination (See e.g., Zhao et al., Nat. Biotechnol., 16:258-261 [1998]), mutagenic PCR (See e.g., Caldwell et al., PCR Methods Appl., 3:S136-S140 [1994]), and cassette mutagenesis (See e.g., Black et al., Proc. Natl. Acad. Sci. USA 93:3525-3529 [1996]).

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,489,146, 6,506,602, 6,506,603, 6,519,065, 6,521,453, 6,528,311, 6,537,746, 6,573,098, 6,576,467, 6,579,678, 6,586,182, 6,602,986, 6,613,514, 6,653,072, 6,716,631, 6,946,296, 6,961,664, 6,995,017, 7,024,312, 7,058,515, 7,105,297, 7,148,054, 7,288,375, 7,421,347, 7,430,477, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,873,499, 7,904,249, 7,957,912, 8,383,346, 8,504,498, 8,849,575, 8,876,066, 8,768,871, and all related non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; US Pat. Appln. Publn. Nos. 2008/0220990, US 2009/0312196, US2014/0005057, US2014/0214391, US2014/0221216; US2015/0050658, US2015/0133307, US2015/0134315 and all related non-US counterparts; WO 95/22625, WO 97/0078, WO 97/35966, WO 98/27230, WO 00/42651, WO 01/75767, and WO 2009/152336; all of which are incorporated herein by reference).

In some embodiments, the enzyme variants obtained following mutagenesis treatment are screened by subjecting the enzyme variants to a defined temperature (or other assay conditions) and measuring the amount of enzyme activity remaining after heat treatments or other assay conditions. DNA containing the polynucleotide encoding the GLA polypeptide is then isolated from the host cell, sequenced to identify the nucleotide sequence changes (if any), and used to express the enzyme in a different or the same host cell. Measuring enzyme activity from the expression libraries can be performed using any suitable method known in the art (e.g., standard biochemistry techniques, such as HPLC analysis).

For engineered polypeptides of known sequence, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides disclosed herein can be prepared by chemical synthesis using the classical phosphoramidite method (See e.g., Beaucage et al., Tetra. Lett., 22:1859-69 [1981]; and Matthes et al., EMBO J., 3:801-05 [1984]), as it is typically practiced in automated synthetic methods. According to the phosphoramidite method, oligonucleotides are synthesized (e.g., in an automatic DNA synthesizer), purified, annealed, ligated and cloned in appropriate vectors.

Accordingly, in some embodiments, a method for preparing the engineered GLA polypeptide can comprise: (a) synthesizing a polynucleotide encoding a polypeptide comprising an amino acid sequence selected from the amino acid sequence of any variant provided in Table 2.1, 2.2, 2.3, 2.4, 2.5, and/or 6.1, as well as SEQ ID NOS:10, 13, 15, 18, 21, and/or 24, and (b) expressing the GLA polypeptide encoded by the polynucleotide. In some embodiments of the method, the amino acid sequence encoded by the polynucleotide can optionally have one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

The expressed engineered GLA polypeptide can be assessed for any desired improved property (e.g., activity, selectivity, stability, acid tolerance, protease sensitivity, etc.), using any suitable assay known in the art, including but not limited to the assays and conditions described herein.

In some embodiments, any of the engineered GLA polypeptides expressed in a host cell are recovered from the cells and/or the culture medium using any one or more of the well-known techniques for protein purification, including, among others, lysozyme treatment, sonication, filtration, salting-out, ultra-centrifugation, and chromatography.

Chromatographic techniques for isolation of the GLA polypeptides include, among others, reverse phase chromatography high performance liquid chromatography, ion exchange chromatography, hydrophobic interaction chromatography, gel electrophoresis, and affinity chromatography. Conditions for purifying a particular enzyme depends, in part, on factors such as net charge, hydrophobicity, hydrophilicity, molecular weight, molecular shape, etc., and will be apparent to those having skill in the art. In some embodiments, affinity techniques may be used to isolate the improved variant GLA enzymes. In some embodiments utilizing affinity chromatography purification, any antibody which specifically binds the variant GLA polypeptide finds use. In some embodiments utilizing affinity chromatography purification, proteins that bind to the glycans covalently attached to GLA find use. In still other embodiments utilizing affinity-chromatography purifications, any small molecule that binds to the GLA active site finds use. For the production of antibodies, various host animals, including but not limited to rabbits, mice, rats, etc., are immunized by injection with a GLA polypeptide (e.g., a GLA variant), or a fragment thereof. in some embodiments, the GLA polypeptide or fragment is attached to a suitable carrier, such as BSA, by means of a side chain functional group or linkers attached to a side chain functional group.

In some embodiments, the engineered GLA polypeptide is produced in a host cell by a method comprising culturing a host cell (e.g., *S. cerevisiae, Daucus carota, Nicotiana tabacum, H. sapiens* (e.g., HEK293T), or *Cricetulus griseus* (e.g., CHO)) comprising a polynucleotide sequence encoding an engineered GLA polypeptide as described herein under conditions conducive to the production of the engineered GLA polypeptide and recovering the engineered GLA polypeptide from the cells and/or culture medium.

In some embodiments, the invention encompasses a method of producing an engineered GLA polypeptide comprising culturing a recombinant eukaryotic cell comprising a polynucleotide sequence encoding an engineered GLA polypeptide having at least 80%, 81%, 82%, 83%, 84%, 85%, 86%, 87%, 88%, 89%, 90%, 95%, 96%, 97%, 98%, 99%, or 100% sequence identity to reference sequences SEQ ID NOS:5 and/or 10, and one or more amino acid residue differences as compared to SEQ ID NO:5 and/or 10, selected from those provided in Tables 2.1, 2.2, 2.4, 2.5, and/or 6.1, and/or combinations thereof when optimally aligned with the amino acid sequence of SEQ ID NO:5 and/or 10, under suitable culture conditions to allow the production of the engineered GLA polypeptide and optionally recovering the engineered GLA polypeptide from the culture and/or cultured bacterial cells.

In some embodiments, once the engineered GLA polypeptides are recovered from the recombinant host cells or cell culture medium, they are further purified by any suitable method(s) known in the art. In some additional embodiments, the purified GLA polypeptides are combined with other ingredients and compounds to provide compositions and formulations comprising the engineered GLA polypeptide as appropriate for different applications and uses (e.g., pharmaceutical compositions). In some additional embodiments, the purified GLA polypeptides, or the formulated GLA polypeptides are lyophilized.

Compositions:

The present invention provides various compositions and formats, including but not limited to those described below. In some embodiments, the present invention provides engineered GLA polypeptides suitable for use in pharmaceutical and other compositions, such as dietary/nutritional supplements.

Depending on the mode of administration, these compositions comprising a therapeutically effective amount of an engineered GLA according to the invention are in the form of a solid, semi-solid, or liquid. In some embodiments, the compositions include other pharmaceutically acceptable components such as diluents, buffers, excipients, salts, emulsifiers, preservatives, stabilizers, fillers, and other ingredients. Details on techniques for formulation and administration are well known in the art and described in the literature.

In some embodiments, the engineered GLA polypeptides are formulated for use in pharmaceutical compositions. Any suitable format for use in delivering the engineered GLA polypeptides find use in the present invention, including but not limited to pills, tablets, gel tabs, capsules, lozenges, dragees, powders, soft gels, sol-gels, gels, emulsions, implants, patches, sprays, ointments, liniments, creams, pastes, jellies, paints, aerosols, chewing gums, demulcents, sticks, solutions, suspensions (including but not limited to oil-based suspensions, oil-in water emulsions, etc.), slurries, syrups, controlled release formulations, suppositories, etc. In some embodiments, the engineered GLA polypeptides are provided in a format suitable for injection or infusion (i.e., in an injectable formulation). In some embodiments, the engineered GLA polypeptides are provided in biocompatible matrices such as sol-gels, including silica-based (e.g., oxysilane) sol-gels. In some embodiments, the engineered GLA polypeptides are encapsulated. In some alternative embodiments, the engineered GLA polypeptides are encapsulated in nanostructures (e.g., nanotubes, nanotubules, nanocapsules, or microcapsules, microspheres, liposomes, etc.). Indeed, it is not intended that the present invention be limited to any particular delivery formulation and/or means of delivery. It is intended that the engineered GLA polypeptides be administered by any suitable means known in the art, including but not limited to parenteral, oral, topical, transdermal, intranasal, intraocular, intrathecal, via implants, etc.

In some embodiments, the engineered GLA polypeptides are chemically modified by glycosylation, chemical cross-linking reagents, pegylation (i.e., modified with polyethylene glycol [PEG] or activated PEG, etc.) or other compounds (See e.g., Ikeda, Amino Acids 29:283-287 [2005]; U.S. Pat. Nos. 7,531,341, 7,534,595, 7,560,263, and 7,53, 653; US Pat. Appln. Publ. Nos. 2013/0039898, 2012/0177722, etc.). Indeed, it is not intended that the present invention be limited to any particular delivery method and/or mechanism.

In some additional embodiments, the engineered GLA polypeptides are provided in formulations comprising matrix-stabilized enzyme crystals. In some embodiments, the formulation comprises a cross-linked crystalline engineered GLA enzyme and a polymer with a reactive moiety that adheres to the enzyme crystals. The present invention also provides engineered GLA polypeptides in polymers.

In some embodiments, compositions comprising the engineered GLA polypeptides of the present invention include one or more commonly used carrier compounds, including but not limited to sugars (e.g., lactose, sucrose, mannitol, and/or sorbitol), starches (e.g., corn, wheat, rice, potato, or other plant starch), cellulose (e.g., methyl cellulose, hydroxypropylmethyl cellulose, sodium carboxy-methylcellulose), gums (e.g., arabic, tragacanth, guar, etc.), and/or proteins (e.g., gelatin, collagen, etc.).

In some embodiments, the present invention provides engineered GLA polypeptides suitable for use in decreasing the concentration of glycolipids in fluids such as blood, cerebrospinal fluid, etc. The dosage of engineered GLA polypeptide(s) administered depends upon the condition or disease, the general condition of the subject, and other factors known to those in the art. In some embodiments, the compositions are intended for single or multiple administrations. In some embodiments, it is contemplated that the concentration of engineered GLA polypeptide(s) in the composition(s) administered to a human with Fabry disease is sufficient to effectively treat, and/or ameliorate disease (e.g., Fabry disease). In some embodiments, the engineered GLA polypeptides are administered in combination with other pharmaceutical and/or dietary compositions.

EXPERIMENTAL

The following Examples, including experiments and results achieved, are provided for illustrative purposes only and are not to be construed as limiting the present invention.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); CDS (coding sequence); DNA (deoxyribonucleic acid); RNA (ribonucleic acid); *E. coli* W3110 (commonly used laboratory *E. coli* strain, available from the *Coli* Genetic Stock Center [CGSC], New Haven, Conn.); HPLC (high pressure liquid chromatography); MWCO (molecular weight cut-off); SDS-PAGE (sodium dodecyl sulfate polyacrylamide gel electrophoresis); PES (polyethersulfone); CFSE (carboxyfluorescein succinimidyl ester); IPTG (isopropyl β-D-1-thiogalactopyranoside); PMBS (polymyxin B sulfate); NADPH (nicotinamide adenine dinucleotide phosphate); GIDH (glutamate dehydrogenase); FIOPC (fold improvements over positive control); PBMC (peripheral blood mononuclear cells); LB (Luria broth); MeOH (methanol); Athens Research (Athens Research Technology, Athens, Ga.); ProSpec (ProSpec Tany Technogene, East Brunswick, N.J.); Sigma-Aldrich (Sigma-Aldrich, St. Louis, Mo.); Ram Scientific (Ram Scientific, Inc., Yonkers, N.Y.); Pall Corp. (Pall, Corp., Pt. Washington, N.Y.); Millipore (Millipore, Corp., Billerica Mass.); Difco (Difco Laboratories, BD Diagnostic Systems, Detroit, Mich.); Molecular Devices (Molecular Devices, LLC, Sunnyvale, Calif.); Kuhner (Adolf Kuhner, AG, Basel, Switzerland); Axygen (Axygen, Inc., Union City, Calif.); Toronto Research Chemicals (Toronto Research Chemicals Inc., Toronto, Ontario, Canada); Cambridge Isotope Laboratories, (Cambridge Isotope Laboratories, Inc., Tewksbury, Mass.); Applied Biosystems (Applied Biosystems, part of Life Technologies, Corp., Grand Island, N.Y.), Agilent (Agilent Technologies, Inc., Santa Clara, Calif.); Thermo Scientific (part of Thermo Fisher Scientific, Waltham, Mass.); Corning (Corning, Inc., Palo Alto, Calif.); Megazyme (Megazyme International, Wicklow, Ireland); Enzo (Enzo Life Sciences, Inc., Farmingdale, N.Y.); GE Healthcare (GE Healthcare Bio-Sciences, Piscataway, N.J.); Pierce (Pierce Biotechnology (now part of Thermo Fisher Scientific), Rockford, Ill.); LI-COR (LI-COR Biotechnology, Lincoln, Nebr.); Amicus (Amicus Therapeutics, Cranbury, N.J.); Phenomenex (Phenomenex, Inc., Torrance, Calif.); Optimal (Optimal Biotech Group, Belmont, Calif.); and Bio-Rad (Bio-Rad Laboratories, Hercules, Calif.).

The following polynucleotide and polypeptide sequences find use in the present invention. In some cases (as shown below), the polynucleotide sequence is followed by the encoded polypeptide.

```
Polynucleotide sequence of full length human GLA cDNA (SEQ
ID NO. 1):
                                                   (SEQ ID NO: 1)
ATGCAGCTGAGGAACCCAGAACTACATCTGGGCTGCGCGCTTGCGCTTCGCTTCCTGGCC

CTCGTTTCCTGGGACATCCCTGGGGCTAGAGCACTGGACAATGGATTGGCAAGGACGCCT

ACCATGGGCTGGCTGCACTGGGAGCGCTTCATGTGCAACCTTGACTGCCAGGAAGAGCC

AGATTCCTGCATCAGTGAGAAGCTCTTCATGGAGATGGCAGAGCTCATGGTCTCAGAAG

GCTGGAAGGATGCAGGTTATGAGTACCTCTGCATTGATGACTGTTGGATGGCTCCCCAAA

GAGATTCAGAAGGCAGACTTCAGGCAGACCCTCAGCGCTTTCCTCATGGGATTCGCCAGC

TAGCTAATTATGTTCACAGCAAAGGACTGAAGCTAGGGATTTATGCAGATGTTGGAAAT

AAAACCTGCGCAGGCTTCCCTGGGAGTTTTGGATACTACGACATTGATGCCCAGACCTTT

GCTGACTGGGGAGTAGATCTGCTAAAATTTGATGGTTGTTACTGTGACAGTTTGGAAAAT

TTGGCAGATGGTTATAAGCACATGTCCTTGGCCCTGAATAGGACTGGCAGAAGCATTGTG

TACTCCTGTGAGTGGCCTCTTTATATGTGGCCCTTTCAAAAGCCCAATTATACAGAAATC

CGACAGTACTGCAATCACTGGCGAAATTTTGCTGACATTGATGATTCCTGGAAAAGTATA

AAGAGTATCTTGGACTGGACATCTTTTAACCAGGAGAGAATTGTTGATGTTGCTGGACCA

GGGGGTTGGAATGACCCAGATATGTTAGTGATTGGCAACTTTGGCCTCAGCTGGAATCAG

CAAGTAACTCAGATGGCCCTCTGGGCTATCATGGCTGCTCCTTTATTCATGTCTAATGACC

TCCGACACATCAGCCCTCAAGCCAAAGCTCTCCTTCAGGATAAGGACGTAATTGCCATCA

ATCAGGACCCCTTGGGCAAGCAAGGGTACCAGCTTAGACAGGGAGACAACTTTGAAGTG

TGGGAACGACCTCTCTCAGGCTTAGCCTGGGCTGTAGCTATGATAAACCGGCAGGAGATT

GGTGGACCTCGCTCTTATACCATCGCAGTTGCTTCCCTGGGTAAAGGAGTGGCCTGTAAT

CCTGCCTGCTTCATCACACAGCTCCTCCCTGTGAAAAGGAAGCTAGGGTTCTATGAATGG

ACTTCAAGGTTAAGAAGTCACATAAATCCCACAGGCACTGTTTTGCTTCAGCTAGAAAAT

ACAATGCAGATGTCATTAAAAGACTTACTTTAG

Polypeptide sequence of full length human GLA:
                                                   (SEQ ID NO: 2)
MQLRNPELHLGCALALRFLALVSWDIPGARALDNGLARTPTMGWLHWERFMCNLDCQEEP

DSCISEKLFMEMAELMVSEGWKDAGYEYLCIDDCWMAPQRDSEGRLQADPQRFPHGIRQLA

NYVHSKGLKLGIYADVGNKTCAGFPGSFGYYDIDAQTFADWGVDLLKFDGCYCDSLENLAD

GYKHMSLALNRTGRSIVYSCEWPLYMWPFQKPNYTEIRQYCNHWRNFADIDDSWKSIKSILD

WTSFNQERIVDVAGPGGWNDPDMLVIGNFGLSWNQQVTQMALWAIMAAPLFMSNDLRHIS
```

-continued

PQAKALLQDKDVIAINQDPLGKQGYQLRQGDNFEVWERPLSGLAWAVAMINRQEIGGPRSY

TIAVASLGKGVACNPACFITQLLPVKRKLGFYEWTSRLRSHINPTGTVLLQLENTMQMSLKD

LL

Polynucleotide sequence of mature yeast codon-optimized (yCDS)
human GLA:

(SEQ ID NO: 3)

TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGAAGTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATGAGTGGACATCTAGGCTAAGAAGTCACATCAATCCTACT

GGTACGGTATTGTTGCAATTGGAGAACACAATGCAAATGTCTTTGAAAGATTTGTTA

Polynucleotide sequence of mature human GLA (native hCDS):

(SEQ ID NO: 4)

CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGAAAAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

```
AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATGAATGGACTTCAAGGTTAAGAAGTCACATAAATCC

CACAGGCACTGTTTTGCTTCAGCTAGAAAATACAATGCAGATGTCATTAAAAGACTTACT

T

Polypeptide sequence of mature Human GLA (SEQ ID NO.5):
                                              (SEQ ID NO: 5)
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWKSIKSILDWTSFNQERIVDVAGPGGWNDPDMLVIGNFG

LSWNQQVTQMALWAIMAAPLFMSNDLRHISPQAKALLQDKDVIAINQDPLGKQGYQLRQG

DNFEVWERPLSGLAWAVAMINRQEIGGPRSYTIAVASLGKGVACNPACFITQLLPVKRKLGF

YEWTSRLRSHINPTGTVLLQLENTMQMSLKDLL

Polynucleotide sequence of pCK110900i E. coli expression vector:
                                              (SEQ ID NO: 6)
TCGAGTTAATTAAGGCAGTGAGCGCAACGCAATTAATGTGAGTTAGCTCACTCATTAGGC

ACCCCAGGCTTTACACTTTATGCTTCCGGCTCGTATGTTGTGTGGAATTGTGAGCGGATA

ACAATTTCACACAGGAAACGGCTATGACCATGATTACGGATTCACTGGCCGTCGTTTTAC

AATCTAGAGGCCAGCCTGGCCATAAGGAGATATACATATGAGTATTCAACATTTCCGTGT

CGCCCTTATTCCCTTTTCTGCGGCATTTTGCCTTCCTGTTTTTGCTCACCCAGAAACGCTG

GTGAAAGTAAAAGATGCTGAAGATCAGTTGGGTGCACGAGTGGGTTACATCGAACTGGA

TCTCAACAGCGGTAAGATCCTTGAGAGTTTTCGCCCCGAAGAGCGTTTTCCAATGATGAG

CACTTTTAAAGTTCTGCTATGTGGCGCGGTATTATCCCGTGTTGACGCCGGGCAAGAGCA

ACTCGGTCGCCGCATACACTATTCTCAGAATGACTTGGTTGAGTACTCACCAGTCACAGA

AAAGCATCTTACGGATGGCATGACAGTAAGAGAATTATGCAGTGCTGCCATAACCATGA

GTGATAACACTGCGGCCAACTTACTTCTGACAACGATCGGAGGACCGAAGGAGCTAACC

GTTTTTTTGCACACCATGGGGGATCATGTAACTCGCCTTGATCGTTGGGAACCGGAGCTG

AATGAAGCCATACCAAACGACGAGCGTGACACCACGATGCCTACAGCAATGGCAACAAC

GTTGCGCAAACTATTAACTGGCGAACTACTTACTCTAGCTTCCCGGCAACAATTAATAGA

CTGGATGGAGGCGGATAAAGTTGCAGGACCACTTCTGCGCTCGGCCCTTCCGGCTGGCTG

GTTTATTGCTGATAAATCTGGAGCCGGTGAGCGTGGGTCTCGCGGTATCATTGCAGCACT

GGGGCCAGATGGTAAGCCCTCCCGTATCGTAGTTATCTACACGACGGGGAGTCAGGCAA

CTATGGATGAACGTAATAGACAGATCGCTGAGATAGGTGCCTCACTGATTAAGCATTGG

GGCCAAACTGGCCACCATCACCATCACCATTAGGGAAGAGCAGATGGGCAAGCTTGACC

TGTGAAGTGAAAAATGGCGCACATTGTGCGACATTTTTTTTGAATTCTACGTAAAAAGC

CGCCGATACATCGGCTGCTTTTTTTTGATAGAGGTTCAAACTTGTGGTATAATGAAATA

AGATCACTCCGGGGCGTATTTTTTGAGTTATCGAGATTTTCAGGAGCTAAGGAAGCTAAA

ATGGAGAAAAAAATCACTGGATATACCACCGTTGATATATCCCAATGGCATCGTAAAGA

ACATTTTGAGGCATTTCAGTCAGTTGCTCAATGTACCTATAACCAGACCGTTCAGCTGGA

TATTACGGCCTTTTTAAAGACCGTAAAGAAAAATAAGCACAAGTTTTATCCGGCCTTTAT
```

-continued

```
TCACATTCTTGCCCGCCTGATGAATGCTCATCCGGAGTTCCGTATGGCAATGAAAGACGG
TGAGCTGGTGATATGGGATAGTGTTCACCCTTGTTACACCGTTTTCCATGAGCAAACTGA
AACGTTTTCATCGCTCTGGAGTGAATACCACGACGATTTCCGGCAGTTTCTACACATATA
TTCGCAAGATGTGGCGTGTTACGGTGAAAACCTGGCCTATTTCCCTAAAGGGTTTATTGA
GAATATGTTTTTCGTCTCAGCCAATCCCTGGGTGAGTTTCACCAGTTTTGATTTAAACGTG
GCCAATATGGACAACTTCTTCGCCCCCGTTTTCACCATGGGCAAATATTATACGCAAGGC
GACAAGGTGCTGATGCCGCTGGCGATTCAGGTTCATCATGCCGTCTGTGATGGCTTCCAT
GTCGGCAGAATGCTTAATGAATTACAACAGTACTGCGATGAGTGGCAGGGCGGGGCGTA
ACTGCAGGAGCTCAAACAGCAGCCTGTATTCAGGCTGCTTTTTTCGTTTTGGTCTGCGCGT
AATCTCTTGCTCTGAAAACGAAAAAACCGCCTTGCAGGGCGGTTTTTCGAAGGTTCTCTG
AGCTACCAACTCTTTGAACCGAGGTAACTGGCTTGGAGGAGCGCAGTCACCAAAACTTG
TCCTTTCAGTTTAGCCTTAACCGGCGCATGACTTCAAGACTAACTCCTCTAAATCAATTAC
CAGTGGCTGCTGCCAGTGGTGCTTTTGCATGTCTTTCCGGGTTGGACTCAAGACGATAGT
TACCGGATAAGGCGCAGCGGTCGGACTGAACGGGGGGTTCGTGCATACAGTCCAGCTTG
GAGCGAACTGCCTACCCGGAACTGAGTGTCAGGCGTGGAATGAGACAAACGCGGCCATA
ACAGCGGAATGACACCGGTAAACCGAAAGGCAGGAACAGGAGAGCGCACGAGGGAGCC
GCCAGGGGAAACGCCTGGTATCTTTATAGTCCTGTCGGGTTTCGCCACCACTGATTTGA
GCGTCAGATTTCGTGATGCTTGTCAGGGGGCGGAGCCTATGGAAAAACGGCTTTGCCG
CGGCCCTCTCACTTCCCTGTTAAGTATCTTCCTGGCATCTTCCAGGAAATCTCCGCCCGT
TCGTAAGCCATTTCCGCTCGCCGCAGTCGAACGACCGAGCGTAGCGAGTCAGTGAGCGA
GGAAGCGGAATATATCCTGTATCACATATTCTGCTGACGCACCGGTGCAGCCTTTTTTCT
CCTGCCACATGAAGCACTTCACTGACACCCTCATCAGTGAACCACCGCTGGTAGCGGTGG
TTTTTTTAGGCCTATGGCCTTTTTTTTTGTGGGAAACCTTTCGCGGTATGGTATTAAAGC
GCCCGGAAGAGAGTCAATTCAGGGTGGTGAATGTGAAACCAGTAACGTTATACGATGTC
GCAGAGTATGCCGGTGTCTCTTATCAGACCGTTTCCCGCGTGGTGAACCAGGCCAGCCAC
GTTTCTGCGAAAACGCGGGAAAAAGTGGAAGCGGCGATGGCGGAGCTGAATTACATTCC
CAACCGCGTGGCACAACAACTGGCGGGCAAACAGTCGTTGCTGATTGGCGTTGCCACCT
CCAGTCTGGCCCTGCACGCGCCGTCGCAAATTGTCGCGGCGATTAAATCTCGCGCCGATC
AACTGGGTGCCAGCGTGGTGGTGTCGATGGTAGAACGAAGCGGCGTCGAAGCCTGTAAA
GCGGCGGTGCACAATCTTCTCGCGCAACGCGTCAGTGGGCTGATCATTAACTATCCGCTG
GATGACCAGGATGCCATTGCTGTGGAAGCTGCCTGCACTAATGTTCCGGCGTTATTCTT
GATGTCTCTGACCAGACACCCATCAACAGTATTATTTTCTCCCATGAAGACGGTACGCGA
CTGGGCGTGGAGCATCTGGTCGCATTGGGTCACCAGCAAATCGCGCTGTTAGCGGGCCC
ATTAAGTTCTGTCTCGGCGCGTCTGCGTCTGGCTGGCTGGCATAAATATCTCACTCGCAA
TCAAATTCAGCCGATAGCGGAACGGGAAGGCGACTGGAGTGCCATGTCCGGTTTTCAAC
AAACCATGCAAATGCTGAATGAGGGCATCGTTTCCACTGCGATGCTGGTTGCCAACGATC
AGATGGCGCTGGGCGCAATGCGCGCCATTACCGAGTCCGGGCTGCGCGTTGGTGCGGAC
ATCTCGGTAGTGGGATACGACGATACCGAAGACAGCTCATGTTATATCCCGCCGTTAACC
ACCATCAAACAGGATTTTCGCCTGCTGGGGCAAACCAGCGTGGACCGCTTGCTGCAACTC
TCTCAGGGCCAGGCGGTTAAGGGCAATCAGCTGTTGCCCGTCTCACTGGTGAAAAGAAA
AACCACCCTGGCGCCCAATACGCAAACCGCCTCTCCCCGCGCGTTGGCCGATTCATTAAT
```

GCAGCTGGCACGACAGGTTTCCCGACTGGAAAGCGGGCAGTGAGCGGTACCCGATAAAA

GCGGCTTCCTGACAGGAGGCCGTTTTGTTTC

Polynucleotide sequence of pYT-72Bg1 secreted yeast expression vector:

(SEQ ID NO: 7)
TTTTTTTTTTTTTTTTTTTTTTTTTTTTTTTTTTTTTTTTTTTTGTACAAATATCATA

AAAAAAGAGAATCTTTTTAAGCAAGGATTTTCTTAACTTCTTCGGCGACAGCATCACCGA

CTTCGGTGGTACTGTTGGAACCACCTAAATCACCAGTTCTGATACCTGCATCCAAAACCT

TTTTAACTGCATCTTCAATGGCTTTACCTTCTTCAGGCAAGTTCAATGACAATTTCAACAT

CATTGCAGCAGACAAGATAGTGGCGATAGGGTTGACCTTATTCTTTGGCAAATCTGGAGC

GGAACCATGGCATGGTTCGTACAAACCAAATGCGGTGTTCTTGTCTGGCAAAGAGGCCA

AGGACGCAGATGGCAACAAACCCAAGGAGCCTGGGATAACGGAGGCTTCATCGGAGAT

GATATCACCAAACATGTTGCTGGTGATTATAATACCATTTAGGTGGGTTGGGTTCTTAAC

TAGGATCATGGCGGCAGAATCAATCAATTGATGTTGAACTTTCAATGTAGGGAATTCGTT

CTTGATGGTTTCCTCCACAGTTTTTCTCCATAATCTTGAAGAGGCCAAAACATTAGCTTTA

TCCAAGGACCAAATAGGCAATGGTGGCTCATGTTGTAGGGCCATGAAAGCGGCCATTCT

TGTGATTCTTTGCACTTCTGGAACGGTGTATTGTTCACTATCCCAAGCGACACCATCACCA

TCGTCTTCCTTTCTCTTACCAAAGTAAATACCTCCCACTAATTCTCTAACAACAACGAAGT

CAGTACCTTTAGCAAATTGTGGCTTGATTGGAGATAAGTCTAAAAGAGAGTCGGATGCA

AAGTTACATGGTCTTAAGTTGGCGTACAATTGAAGTTCTTTACGGATTTTTAGTAAACCTT

GTTCAGGTCTAACACTACCGGTACCCCATTTAGGACCACCCACAGCACCTAACAAAACG

GCATCAGCCTTTTTGGAGGCTTCCAGCGCCTCATTTGGAAGTGGAACACCTGTAGCATCG

ATAGCAGCCCCCCCAATTAAATGATTTTCGAAATCGAACTTGACATTGGAACGAACATCA

GAAATAGCTTTAAGAACCTTAATGGCTTCGGCTGTGATTTCTTGACCAACGTGGTCACCT

GGCAAAACGACGATTTTTTTAGGGGCAGACATTACAATGGTATATCCTTGAAATATATAT

AAAAAAAAAAAAAAAAAAAAAAAAAAAAATGCAGCTTCTCAATGATATTCGAATAC

GCTTTGAGGAGATACAGCCTAATATCCGACAAACTGTTTTACAGATTTACGATCGTACTT

GTTACCCATCATTGAATTTTGAACATCCGAACCTGGGAGTTTTCCCTGAAACAGATAGTA

TATTTGAACCTGTATAATAATATATAGTCTAGCGCTTTACGGAAGACAATGTATGTATTT

CGGTTCCTGGAGAAACTATTGCATCTATTGCATAGGTAATCTTGCACGTCGCATCCCCGG

TTCATTTTCTGCGTTTCCATCTTGCACTTCAATAGCATATCTTTGTTAACGAAGCATCTGT

GCTTCATTTTGTAGAACAAAAATGCAACGCGAGAGCGCTAATTTTTCAAACAAAGAATCT

GAGCTGCATTTTTACAGAACAGAAATGCAACGCGAAAGCGCTATTTTACCAACGAAGAA

TCTGTGCTTCATTTTTGTAAAACAAAAATGCAACGCGAGAGCGCTAATTTTTCAAACAAA

GAATCTGAGCTGCATTTTTACAGAACAGAAATGCAACGCGAGAGCGCTATTTTACCAAC

AAAGAATCTATACTTCTTTTTTGTTCTACAAAAATGCATCCCGAGAGCGCTATTTTCTAA

CAAAGCATCTTAGATTACTTTTTTTCTCCTTTGTGCGCTCTATAATGCAGTCTCTTGATAA

CTTTTTGCACTGTAGGTCCGTTAAGGTTAGAAGAAGGCTACTTTGGTGTCTATTTTCTCTT

CCATAAAAAAAGCCTGACTCCACTTCCCGCGTTTACTGATTACTAGCGAAGCTGCGGGTG

CATTTTTTCAAGATAAAGGCATCCCCGATTATATTCTATACCGATGTGGATTGCGCATACT

TTGTGAACAGAAAGTGATAGCGTTGATGATTCTTCATTGGTCAGAAAATTATGAACGGTT

TCTTCTATTTTGTCTCTATATACTACGTATAGGAAATGTTTACATTTTCGTATTGTTTTCGA

-continued

```
TTCACTCTATGAATAGTTCTTACTACAATTTTTTTGTCTAAAGAGTAATACTAGAGATAAA

CATAAAAAATGTAGAGGTCGAGTTTAGATGCAAGTTCAAGGAGCGAAAGGTGGATGGGT

AGGTTATATAGGGATATAGCACAGAGATATATAGCAAAGAGATACTTTTGAGCAATGTT

TGTGGAAGCGGTATTCGCAATATTTTAGTAGCTCGTTACAGTCCGGTGCGTTTTGGTTTT

TTGAAAGTGCGTCTTCAGAGCGCTTTTGGTTTTCAAAAGCGCTCTGAAGTTCCTATACTTT

CTAGAGAATAGGAACTTCGGAATAGGAACTTCAAAGCGTTTCCGAAAACGAGCGCTTCC

GAAAATGCAACGCGAGCTGCGCACATACAGCTCACTGTTCACGTCGCACCTATATCTGCG

TGTTGCCTGTATATATATATACATGAGAAGAACGGCATAGTGCGTGTTTATGCTTAAATG

CGTACTTATATGCGTCTATTTATGTAGGATGAAAGGTAGTCTAGTACCTCCTGTGATATTA

TCCCATTCCATGCGGGGTATCGTATGCTTCCTTCAGCACTACCCTTTAGCTGTTCTATATG

CTGCCACTCCTCAATTGGATTAGTCTCATCCTTCAATGCTATCATTTCCTTTGATATTGGA

TCATATGCATAGTACCGAGAAACTAGTGCGAAGTAGTGATCAGGTATTGCTGTTATCTGA

TGAGTATACGTTGTCCTGGCCACGGCAGAAGCACGCTTATCGCTCCAATTTCCCACAACA

TTAGTCAACTCCGTTAGGCCCTTCATTGAAAGAAATGAGGTCATCAAATGTCTTCCAATG

TGAGATTTTGGGCCATTTTTTATAGCAAAGATTGAATAAGGCGCATTTTTCTTCAAAGCTT

TATTGTACGATCTGACTAAGTTATCTTTTAATAATTGGTATTCCTGTTTATTGCTTGAAGA

ATTGCCGGTCCTATTTACTCGTTTTAGGACTGGTTCAGAATTCCTCAAAAATTCATCCAAA

TATACAAGTGGATCGATGATAAGCTGTCAAACATGAGAATTCTTGAAGACGAAAGGGCC

TCGTGATACGCCTATTTTTATAGGTTAATGTCATGATAATAATGGTTTCTTAGACGTCAGG

TGGCACTTTTCGGGGAAATGTGCGCGGAACCCCTATTTGTTTATTTTTCTAAATACATTCA

AATATGTATCCGCTCATGAGACAATAACCCTGATAAATGCTTCAATAATATTGAAAAAGG

AAGAGTATGAGTATTCAACATTTCCGTGTCGCCCTTATTCCCTTTTTTGCGGCATTTTGCC

TTCCTGTTTTTGCTCACCCAGAAACGCTGGTGAAAGTAAAAGATGCTGAAGATCAGTTGG

GTGCACGAGTGGGTTACATCGAACTGGATCTCAACAGCGGTAAGATCCTTGAGAGTTTTC

GCCCCGAAGAACGTTTTCCAATGATGAGCACTTTTAAAGTTCTGCTATGTGGCGCGGTAT

TATCCCGTGTTGACGCCGGGCAAGAGCAACTCGGTCGCCGCATACACTATTCTCAGAATG

ACTTGGTTGAGTACTCACCAGTCACAGAAAAGCATCTTACGGATGGCATGACAGTAAGA

GAATTATGCAGTGCTGCCATAACCATGAGTGATAACACTGCGGCCAACTTACTTCTGACA

ACGATCGGAGGACCGAAGGAGCTAACCGCTTTTTTGCACAACATGGGGGATCATGTAAC

TCGCCTTGATCGTTGGGAACCGGAGCTGAATGAAGCCATACCAAACGACGAGCGTGACA

CCACGATGCCTGCAGCAATGGCAACAACGTTGCGCAAACTATTAACTGGCGAACTACTT

ACTCTAGCTTCCCGGCAACAATTAATAGACTGGATGGAGGCGGATAAAGTTGCAGGACC

ACTTCTGCGCTCGGCCCTTCCGGCTGGCTGGTTTATTGCTGATAAATCTGGAGCCGGTGA

GCGTGGGTCTCGCGGTATCATTGCAGCACTGGGGCCAGATGGTAAGCCCTCCCGTATCGT

AGTTATCTACGACGGGGAGTCAGGCAACTATGGATGAACGAAATAGACAGATCGCTG

AGATAGGTGCCTCACTGATTAAGCATTGGTAACTGTCAGACCAAGTTTACTCATATATAC

TTTAGATTGATTTAAAACTTCATTTTTAATTTAAAAGGATCTAGGTGAAGATCCTTTTTGA

TAATCTCATGACCAAAATCCCTTAACGTGAGTTTTCGTTCCACTGAGCGTCAGACCCCGT

AGAAAAGATCAAAGGATCTTCTTGAGATCCTTTTTTTCTGCGCGTAATCTGCTGCTTGCA

AACAAAAAAACCACCGCTACCAGCGGTGGTTTGTTTGCCGGATCAAGAGCTACCAACTC
```

-continued

```
TTTTTCCGAAGGTAACTGGCTTCAGCAGAGCGCAGATACCAAATACTGTCCTTCTAGTGT
AGCCGTAGTTAGGCCACCACTTCAAGAACTCTGTAGCACCGCCTACATACCTCGCTCTGC
TAATCCTGTTACCAGTGGCTGCTGCCAGTGGCGATAAGTCGTGTCTTACCGGGTTGGACT
CAAGACGATAGTTACCGGATAAGGCGCAGCGGTCGGGCTGAACGGGGGGTTCGTGCACA
CAGCCCAGCTTGGAGCGAACGACCTACACCGAACTGAGATACCTACAGCGTGAGCTATG
AGAAAGCGCCACGCTTCCCGAAGGGAGAAAGGCGGACAGGTATCCGGTAAGCGGCAGG
GTCGGAACAGGAGAGCGCACGAGGGAGCTTCCAGGGGGAAACGCCTGGTATCTTTATAG
TCCTGTCGGGTTTCGCCACCTCTGACTTGAGCGTCGATTTTTGTGATGCTCGTCAGGGGGG
CGGAGCCTATGGAAAAACGCCAGCAACGCGGCCTTTTTACGGTTCCTGGCCTTTTGCTGG
CCTTTTGCTCACATGTTCTTTCCTGCGTTATCCCCTGATTCTGTGGATAACCGTATTACCG
CCTTTGAGTGAGCTGATACCGCTCGCCGCAGCCGAACGACCGAGCGCAGCGAGTCAGTG
AGCGAGGAAGCGGAAGAGCGCCTGATGCGGTATTTTCTCCTTACGCATCTGTGCGGTATT
TCACACCGCATATGGTGCACTCTCAGTACAATCTGCTCTGATGCCGCATAGTTAAGCCAG
TATACACTCCGCTATCGCTACGTGACTGGGTCATGGCTGCGCCCCGACACCCGCCAACAC
CCGCTGACGCGCCCTGACGGGCTTGTCTGCTCCCGGCATCCGCTTACAGACAAGCTGTGA
CCGTCTCCGGGAGCTGCATGTGTCAGAGGTTTTCACCGTCATCACCGAAACGCGCGAGGC
AGCTGCGGTAAAGCTCATCAGCGTGGTCGTGAAGCGATTCACAGATGTCTGCCTGTTCAT
CCGCGTCCAGCTCGTTGAGTTTCTCCAGAAGCGTTAATGTCTGGCTTCTGATAAAGCGGG
CCATGTTAAGGGCGGTTTTTTCCTGTTTGGTCACTGATGCCTCCGTGTAAGGGGGATTTCT
GTTCATGGGGGTAATGATACCGATGAAACGAGAGAGGATGCTCACGATACGGGTTACTG
ATGATGAACATGCCCGGTTACTGGAACGTTGTGAGGGTAAACAACTGGCGGTATGGATG
CGGCGGGACCAGAGAAAAATCACTCAGGGTCAATGCCAGCGCTTCGTTAATACAGATGT
AGGTGTTCCACAGGGTAGCCAGCAGCATCCTGCGATGCAGATCCGGAACATAATGGTGC
AGGGCGCTGACTTCCGCGTTTCCAGACTTTACGAAACACGGAAACCGAAGACCATTCAT
GTTGTTGCTCAGGTCGCAGACGTTTTGCAGCAGCAGTCGCTTCACGTTCGCTCGCGTATC
GGTGATTCATTCTGCTAACCAGTAAGGCAACCCCGCCAGCCTAGCCGGGTCCTCAACGAC
AGGAGCACGATCATGCGCACCCGTGGCCAGGACCCAACGCTGCCCGAGATGCGCCGCGT
GCGGCTGCTGGAGATGGCGGACGCGATGGATATGTTCTGCCAAGGGTTGGTTTGCGCATT
CACAGTTCTCCGCAAGAATTGATTGGCTCCAATTCTTGGAGTGGTGAATCCGTTAGCGAG
GTGCCGCCGGCTTCCATTCAGGTCGAGGTGGCCCGGCTCCATGCACCGCGACGCAACGC
GGGGAGGCAGACAAGGTATAGGGCGGCGCCTACAATCCATGCCAACCCGTTCCATGTGC
TCGCCGAGGCGGCATAAATCGCCGTGACGATCAGCGGTCCAATGATCGAAGTTAGGCTG
GTAAGAGCCGCGAGCGATCCTTGAAGCTGTCCCTGATGGTCGTCATCTACCTGCCTGGAC
AGCATGGCCTGCAACGCGGGCATCCCGATGCCGCCGGAAGCGAGAAGAATCATAATGGG
GAAGGCCATCCAGCCTCGCGTCGCGAACGCCAGCAAGACGTAGCCCAGCGCGTCGGCCG
CCATGCCGGCGATAATGGCCTGCTTCTCGCCGAAACGTTTGGTGGCGGGACCAGTGACG
AAGGCTTGAGCGAGGGCGTGCAAGATTCCGAATACCGCAAGCGACAGGCCGATCATCGT
CGCGCTCCAGCGAAAGCGGTCCTCGCCGAAAATGACCCAGAGCGCTGCCGGCACCTGTC
CTACGAGTTGCATGATAAAGAAGACAGTCATAAGTGCGGCGACGATAGTCATGCCCCGC
GCCCACCGGAAGGAGCTGACTGGGTTGAAGGCTCTCAAGGGCATCGGTCGAGGATCTGG
GCAAAACGTAGGGGCAAACAAACGGAAAAATCGTTTCTCAAATTTTCTGATGCCAAGAA
```

```
CTCTAACCAGTCTTATCTAAAAATTGCCTTATGATCCGTCTCTCCGGTTACAGCCTGTGTA

ACTGATTAATCCTGCCTTTCTAATCACCATTCTAATGTTTTAATTAAGGGATTTTGTCTTC

ATTAACGGCTTTCGCTCATAAAAATGTTATGACGTTTTGCCCGCAGGCGGGAAACCATCC

ACTTCACGAGACTGATCTCCTCTGCCGGAACACCGGGCATCTCCAACTTATAAGTTGGAG

AAATAAGAGAATTTCAGATTGAGAGAATGAAAAAAAAAAAAAAAAAAAGGCAGAGGAG

AGCATAGAAATGGGGTTCACTTTTTGGTAAAGCTATAGCATGCCTATCACATATAAATAG

AGTGCCAGTAGCGACTTTTTTCACACTCGAAATACTCTTACTACTGCTCTCTTGTTGTTTT

TATCACTTCTTGTTTCTTCTTGGTAAATAGAATATCAAGCTACAAAAAGCATACAATCAA

CTATCAACTATTAACTATATCGTAATACACAGGATCCACCATGAAGGCTGCTGCGCTTTC

CTGCCTCTTCGGCAGTACCCTTGCCGTTGCAGGCGCCATTGAATCGAGAAAGGTTCACCA

GAAGCCCCTCGCGAGATCTGAACCTTTTTACCCGTCGCCATGGATGAATCCCAACGCCAT

CGGCTGGGCGGAGGCCTATGCCCAGGCCAAGTCCTTTGTCTCCCAAATGACTCTGCTAGA

GAAGGTCAACTTGACCACGGGAGTCGGCTGGGGGAGGAGCAGTGCGTCGGCAACGTG

GGCGCGATCCCTCGCCTTGGACTTCGCAGTCTGTGCATGCATGACTCCCCTCTCGGCGTG

CGAGGAACCGACTACAACTCAGCGTTCCCCTCTGGCCAGACCGTTGCTGCTACCTGGGAT

CGCGGTCTGATGTACCGTCGCGGCTACGCAATGGGCCAGGAGGCCAAAGGCAAGGGCAT

CAATGTCCTTCTCGGACCAGTCGCCGGCCCCCTTGGCCGCATGCCCGAGGGCGGTCGTAA

CTGGGAAGGCTTCGCTCCGGATCCCGTCCTTACCGGCATCGGCATGTCCGAGACGATCAA

GGGCATTCAGGATGCTGGCGTCATCGCTTGTGCGAAGCACTTTATTGGAAACGAGCAGG

AGCACTTCAGACAGGTGCCAGAAGCCCAGGGATACGGTTACAACATCAGCGAAACCCTC

TCCTCCAACATTGACGACAAGACCATGCACGAGCTCTACCTTTGGCCGTTTGCCGATGCC

GTCCGGGCCGGCGTCGGCTCTGTCATGTGCTCGTACAACCAGGGCAACAACTCGTACGCC

TGCCAGAACTCGAAGCTGCTGAACGACCTCCTCAAGAACGAGCTTGGGTTTCAGGGCTTC

GTCATGAGCGACTGGTGGGCACAGCACACTGGCGCAGCAAGCGCCGTGGCTGGTCTCGA

TATGTCCATGCCGGGCGACACCATGGTCAACACTGGCGTCAGTTTCTGGGGCGCCAATCT

CACCCTCGCCGTCCTCAACGGCACAGTCCCTGCCTACCGTCTCGACGACATGTGCATGCG

CATCATGGCCGCCCTCTTCAAGGTCACCAAGACCACCGACCTGGAACCGATCAACTTCTC

CTTCTGGACCCGCGACACTTATGGCCCGATCCACTGGGCCGCCAAGCAGGGCTACCAGG

AGATTAATTCCCACGTTGACGTCCGCGCCGACCACGGCAACCTCATCCGGAACATTGCCG

CCAAGGGTACGGTGCTGCTGAAGAATACCGGCTCTCTACCCCTGAACAAGCCAAAGTTC

GTGGCCGTCATCGGCGAGGATGCTGGGCCGAGCCCCAACGGGCCCAACGGCTGCAGCGA

CCGCGGCTGTAACGAAGGCACGCTCGCCATGGGCTGGGGATCCGGCACAGCCAACTATC

CGTACCTCGTTTCCCCCGACGCCGCGCTCCAGGCGCGGGCCATCCAGGACGGCACGAGG

TACGAGAGCGTCCTGTCCAACTACGCCGAGGAAAATACAAAGGCTCTGGTCTCGCAGGC

CAATGCAACCGCCATCGTCTTCGTCAATGCCGACTCAGGCGAGGGCTACATCAACGTGG

ACGGTAACGAGGGCGACCGTAAGAACCTGACTCTCTGGAACAACGGTGATACTCTGGTC

AAGAACGTCTCGAGCTGGTGCAGCAACACCATCGTCGTCATCCACTCGGTCGGCCCGGTC

CTCCTGACCGATTGGTACGACAACCCCAACATCACGGCCATTCTCTGGGCTGGTCTTCCG

GGCCAGGAGTCGGGCAACTCCATCACCGACGTGCTTTACGGCAAGGTCAACCCCGCCGC

CCGCTCGCCCTTCACTTGGGGCAAGACCCGCGAAAGCTATGGCGCGGACGTCCTGTACA
```

-continued

```
AGCCGAATAATGGCAATTGGGCGCCCCAACAGGACTTCACCGAGGGCGTCTTCATCGAC

TACCGCTACTTCGACAAGGTTGACGATGACTCGGTCATCTACGAGTTCGGCCACGGCCTG

AGCTACACCACCTTCGAGTACAGCAACATCCGCGTCGTCAAGTCCAACGTCAGCGAGTA

CCGGCCCACGACGGGCACCACGATTCAGGCCCCGACGTTTGGCAACTTCTCCACCGACCT

CGAGGACTATCTCTTCCCCAAGGACGAGTTCCCCTACATCCCGCAGTACATCTACCCGTA

CCTCAACACGACCGACCCCCGGAGGGCCTCGGGCGATCCCCACTACGGCCAGACCGCCG

AGGAGTTCCTCCCGCCCCACGCCACCGATGACGACCCCCAGCCGCTCCTCCGGTCCTCGG

GCGGAAACTCCCCCGGCGGCAACCGCCAGCTGTACGACATTGTCTACACAATCACGGCC

GACATCACGAATACGGGCTCCGTTGTAGGCGAGGAGGTACCGCAGCTCTACGTCTCGCT

GGGCGGTCCCGAGGATCCCAAGGTGCAGCTGCGCGACTTTGACAGGATGCGGATCGAAC

CCGGCGAGACGAGGCAGTTCACCGGCCGCCTGACGCGCAGAGATCTGAGCAACTGGGAC

GTCACGGTGCAGGACTGGGTCATCAGCAGGTATCCCAAGACGGCATATGTTGGGAGGAG

CAGCCGGAAGTTGGATCTCAAGATTGAGCTTCCTTGATAAGTCGACCTCGACTTTGTTCC

CACTGTACTTTTAGCTCGTACAAAATACAATATACTTTTCATTTCTCCGTAAACAACATGT

TTTCCCATGTAATATCCTTTTCTATTTTTCGTTCCGTTACCAACTTTACACATACTTTATAT

AGCTATTCACTTCTATACACTAAAAAACTAAGACAATTTTAATTTTGCTGCCTGCCATATT

TCAATTTGTTATAAATTCCTATAATTTATCCTATTAGTAGCTAAAAAAAGATGAATGTGA

ATCGAATCCTAAGAGAATTGGATCTGATCCACAGGACGGGTGTGGTCGCCATGATCGCG

TAGTCGATAGTGGCTCCAAGTAGCGAAGCGAGCAGGACTGGGCGGCGGCCAAAGCGGTC

GGACAGTGCTCCGAGAACGGGTGCGCATAGAAATTGCATCAACGCATATAGCGCTAGCA

GCACGCCATAGTGACTGGCGATGCTGTCGGAATGGACGATATCCCGCAAGAGGCCCGGC

AGTACCGGCATAACCAAGCCTATGCCTACAGCATCCAGGGTGACGGTGCCGAGGATGAC

GATGAGCGCATTGTTAGATTTCATACACGGTGCCTGACTGCGTTAGCAATTTAACTGTGA

TAAACTACCGCATTAAAGCTTTTTCTTTCCAATTTTTTTTTTTCGTCATTATAAAAATCAT

TACGACCGAGATTCCCGGGTAATAACTGATATAATTAAATTGAAGCTCTAATTTGTGAGT

TTAGTATACATGCATTTACTTATAATACAGTTTTTTAGTTTTGCTGGCCGCATCTTCTCAA

ATATGCTTCCCAGCCTGCTTTTCTGTAACGTTCACCCTCTACCTTAGCATCCCTTCCCTTTG

CAAATAGTCCTCTTCCAACAATAATAATGTCAGATCCTGTAGAGACCACATCATCCACGG

TTCTATACTGTTGACCCAATGCGTCTCCCTTGTCATCTAAACCCACACCGGGTGTCATAAT

CAACCAATCGTAACCTTCATCTCTTCCACCCATGTCTCTTTGAGCAATAAAGCCGATAAC

AAAATCTTTGTCGCTCTTCGCAATGTCAACAGTACCCTTAGTATATTCTCCAGTAGATAG

GGAGCCCTTGCATGACAATTCTGCTAACATCAAAAGGCCTCTAGGTTCCTTTGTTACTTCT

TCTGCCGCCTGCTTCAAACCGCTAACAATACCTGGGCCCACCACACCGTGTGCATTCGTA

ATGTCTGCCCATTCTGCTATTCTGTATACACCCGCAGAGTACTGCAATTTGACTGTATTAC

CAATGTCAGCAAATTTTCTGTCTTCGAAGAGTAAAAAATTGTACTTGGCGGATAATGCCT

TTAGCGGCTTAACTGTGCCCTCCATGGAAAAATCAGTCAAGATATCCACATGTGTTTTTA

GTAAACAAATTTTGGGACCTAATGCTTCAACTAACTCCAGTAATTCCTTGGTGGTACGAA

CATCCAATGAAGCACACAAGTTTGTTTGCTTTTCGTGCATGATATTAAATAGCTTGGCAG

CAACAGGACTAGGATGAGTAGCAGCACGTTCCTTATATGTAGCTTTCGACATGATTTATC

TTCGTTTCCTGCAGGTTTTTGTTCTGTGCAGTTGGGTTAAGAATACTGGGCAATTTCATGT

TTCTTCAACACTACATATGCGTATATATACCAATCTAAGTCTGTGCTCCTTCCTTCGTTCT
```

-continued

```
TCCTTCTGTTCGGAGATTACCGAATCAAAAAAATTTCAAGGAAACCGAAATCAAAAAAA
AGAATAAAAAAAAAATGATGAATTGAAAAGCTTATCGATCCTACCCCTTGCGCTAAAGA
AGTATATGTGCCTACTAACGCTTGTCTTTGTCTCTGTCACTAAACACTGGATTATTACTCC
CAGATACTTATTTTGGACTAATTTAAATGATTTCGGATCAACGTTCTTAATATCGCTGAAT
CTTCCACAATTGATGAAAGTAGCTAGGAAGAGGAATTGGTATAAAGTTTTTGTTTTTGTA
AATCTCGAAGTATACTCAAACGAATTTAGTATTTTCTCAGTGATCTCCCAGATGCTTTCAC
CCTCACTTAGAAGTGCTTTAAGCATTTTTTTACTGTGGCTATTTCCCTTATCTGCTTCTTCC
GATGATTCGAACTGTAATTGCAAACTACTTACAATATCAGTGATATCAGATTGATGTTTT
TGTCCATAGTAAGGAATAATTGTAAATTCCCAAGCAGGAATCAATTTCTTTAATGAGGCT
TCCAGAATTGTTGCTTTTTGCGTCTTGTATTTAAACTGGAGTGATTTATTGACAATATCGA
AACTCAGCGAATTGCTTATGATAGTATTATAGCTCATGAATGTGGCTCTCTTGATTGCTGT
TCCGTTATGTGTAATCATCCAACATAAATAGGTTAGTTCAGCAGCACATAATGCTATTTT
CTCACCTGAAGGTCTTTCAAACCTTTCCACAAACTGACGAACAAGCACCTTAGGTGGTGT
TTTACATAATATATCAAATTGTGGCATGCTTAGCGCCGATCTTGTGTGCAATTGATATCTA
GTTTCAACTACTCTATTTATCTTGTATCTTGCAGTATTCAAACACGCTAACTCGAAAAACT
AACTTTAATTGTCCTGTTTGTCTCGCGTTCTTTCGAAAAATGCACCGGCCGCGCATTATTT
GTACTGCGAAAATAATTGGTACTGCGGTATCTTCATTTCATATTTTAAAAATGCACCTTTG
CTGCTTTTCCTTAATTTTTAGACGGCCCGCAGGTTCGTTTTGCGGTACTATCTTGTGATAA
AAAGTTGTTTTGACATGTGATCTGCACAGATTTTATAATGTAATAAGCAAGAATACATTA
TCAAACGAACAATACTGGTAAAAGAAAACCAAAATGGACGACATTGAAACAGCCAAGA
ATCTGACGGTAAAAGCACGTACAGCTTATAGCGTCTGGGATGTATGTCGGCTGTTTATTG
AAATGATTGCTCCTGATGTAGATATTGATATAGAGAGTAAACGTAAGTCTGATGAGCTAC
TCTTTCCAGGATATGTCATAAGGCCCATGGAATCTCTCACAACCGGTAGGCCGTATGGTC
TTGATTCTAGCGCAGAAGATTCCAGCGTATCTTCTGACTCCAGTGCTGAGGTAATTTTGC
CTGCTGCGAAGATGGTTAAGGAAAGGTTTGATTCGATTGGAAATGGTATGCTCTCTTCAC
AAGAAGCAAGTCAGGCTGCCATAGATTTGATGCTACAGAATAACAAGCTGTTAGACAAT
AGAAAGCAACTATACAAATCTATTGCTATAATAATAGGAAGATTGCCCGAGAAAGACAA
GAAGAGAGCTACCGAAATGCTCATGAGAAAAATGGATTGTACACAGTTATTAGTCCCAC
CAGCTCCAACGGAAGAAGATGTTATGAAGCTCGTAAGCGTCGTTACCCAATTGCTTACTT
TAGTTCCACCAGATCGTCAAGCTGCTTTAATAGGTGATTTATTCATCCCGGAATCTCTAA
AGGATATATTCAATAGTTTCAATGAACTGGCGGCAGAGAATCGTTTACAGCAAAAAAAG
AGTGAGTTGGAAGGAAGGACTGAAGTGAACCATGCTAATACAAATGAAGAAGTTCCCTC
CAGGCGAACAAGAAGTAGAGACACAAATGCAAGAGGAGCATATAAATTACAAAACACC
ATCACTGAGGGCCCTAAAGCGGTTCCCACGAAAAAAAGGAGAGTAGCAACGAGGGTAA
GGGGCAGAAAATCACGTAATACTTCTAGGGTATGATCCAATATCAAAGGAAATGATAGC
ATTGAAGGATGAGACTAATCCAATTGAGGAGTGGCAGCATATAGAACAGCTAAAGGGTA
GTGCTGAAGGAAGCATACGATACCCCGCATGGAATGGGATAATATCACAGGAGGTACTA
GACTACCTTTCATCCTACATAAATAGACGCATATAAGTACGCATTTAAGCATAAACACGC
ACTATGCCGTTCTTCTCATGTATATATATATACAGGCAACACGCAGATATAGGTGCGACG
TGAACAGTGAGCTGTATGTGCGCAGCTCGCGTTGCATTTTCGGAAGCGCTCGTTTTCGGA
```

-continued

```
AACGCTTTGAAGTTCCTATTCCGAAGTTCCTATTCTCTAGAAAGTATAGGAACTTCAGAG

CGCTTTTGAAAACCAAAAGCGCTCTGAAGACGCACTTTCAAAAAACCAAAAACGCACCG

GACTGTAACGAGCTACTAAAATATTGCGAATACCGCTTCCACAAACATTGCTCAAAAGTA

TCTCTTTGCTATATATCTCTGTGCTATATCCCTATATAACCTACCCATCCACCTTTCGCTCC

TTGAACTTGCATCTAAACTCGACCTCTACATCAACAGGCTTCCAATGCTCTTCAAATTTTA

CTGTCAAGTAGACCCATACGGCTGTAATATGCTGCTCTTCATAATGTAAGCTTATCTTTAT

CGAATCGTGTGAAAAACTACTACCGCGATAAACCTTTACGGTTCCCTGAGATTGAATTAG

TTCCTTTAGTATATGATACAAGACACTTTTGAACTTTGTACGACGAATTTTGAGGTTCGCC

ATCCTCTGGCTATTTCCAATTATCCTGTCGGCTATTATCTCCGCCTCAGTTTGATCTTCCGC

TTCAGACTGCCATTTTTCACATAATGAATCTATTTCACCCCACAATCCTTCATCCGCCTCC

GCATCTTGTTCCGTTAAACTATTGACTTCATGTTGTACATTGTTTAGTTCACGAGAAGGGT

CCTCTTCAGGCGGTAGCTCCTGATCTCCTATATGACCTTTATCCTGTTCTCTTTCCACAAA

CTTAGAAATGTATTCATGAATTATGGAGCACCTAATAACATTCTTCAAGGCGGAGAAGTT

TGGGCCAGATGCCCAATATGCTTGACATGAAAACGTGAGAATGAATTTAGTATTATTGTG

ATATTCTGAGGCAATTTTATTATAATCTCGAAGATAAGAGAAGAATGCAGTGACCTTTGT

ATTGACAAATGGAGATTCCATGTATCTAAAAAATACGCCTTTAGGCCTTCTGATACCCTT

TCCCCTGCGGTTTAGCGTGCCTTTTACATTAATATCTAAACCCTCTCCGATGGTGGCCTTT

AACTGACTAATAAATGCAACCGATATAAACTGTGATAATTCTGGGTGATTTATGATTCGA

TCGACAATTGTATTGTACACTAGTGCAGGATCAGGCCAATCCAGTTCTTTTTCAATTACC

GGTGTGTCGTCTGTATTCAGTACATGTCCAACAAATGCAAATGCTAACGTTTTGTATTTCT

TATAATTGTCAGGAACTGGAAAAGTCCCCCTTGTCGTCTCGATTACACACCTACTTTCATC

GTACACCATAGGTTGGAAGTGCTGCATAATACATTGCTTAATACAAGCAAGCAGTCTCTC

GCCATTCATATTTCAGTTATTTTCCATTACAGCTGATGTCATTGTATATCAGCGCTGTAAA

AATCTATCTGTTACAGAAGGTTTTCGCGGTTTTTATAAACAAAACTTTCGTTACGAAATC

GAGCAATCACCCCAGCTGCGTATTTGGAAATTCGGGAAAAAGTAGAGCAACGCGAGTTG

CATTTTTTACACCATAATGCATGATTAACTTCGAGAAGGGATTAAGGCTAATTTCACTAG

TATGTTTCAAAAACCTCAATCTGTCCATTGAATGCCTTATAAAACAGCTATAGATTGCAT

AGAAGAGTTAGCTACTCAATGCTTTTTGTCAAAGCTTACTGATGATGATGTGTCTACTTTC

AGGCGGGTCTGTAGTAAGGAGAATGACATTATAAAGCTGGCACTTAGAATTCCACGGAC

TATAGACTATACTAGTATACTCCGTCTACTGTACGATACACTTCCGCTCAGGTCCTTGTCC

TTTAACGAGGCCTTACCACTCTTTTGTTACTCTATTGATCCAGCTCAGCAAAGGCAGTGTG

ATCTAAGATTCTATCTTCGCGATGTAGTAAAACTAGCTAGACCGAGAAAGAGACTAGAA

ATGCAAAAGGCACTTCTACAATGGCTGCCATCATTATTATCCGATGTGACGCTGCA
```

Polynucleotide sequence of Variant No. 73 yCDS:
(SEQ ID NO: 8)
```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT
```

-continued

```
GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATGAGTGGACATCTAGGCTAAGAAGTCACATCAATCCTACT

GGTACGGTATTGTTGCAATTGGAGAACACAATGCAAATGTCTTTGAAAGATTTGTTA
```

Polynucleotide sequence of Variant No. 73:
(SEQ ID NO: 9)
```
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATGAATGGACTTCAAGGTTAAGAAGTCACATAAATCC

CACAGGCACTGTTTTGCTTCAGCTAGAAAATACAATGCAGATGTCATTAAAAGACTTACT

T
```

Polypeptide sequence of Variant No. 73:
(SEQ ID NO: 10)
```
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSFNQERIVDVAGPGGWNDPDMLVIGNFG
```

-continued

LSWNQQVTQMALWAIMAAPLFMSNDLRHISPQAKALLQDKDVIAINQDPLGKQGYQLRQG

DNFEVWERPLSGLAWAVAMINRQEIGGPRSYTIAVASLGKGVACNPACFITQLLPVKRKLGF

YEWTSRLRSHINPTGTVLLQLENTMQMSLKDLL

Polynucleotide sequence of Variant No. 218 yCDS:
(SEQ ID NO: 11)
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATTATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATAACTGGACATCTAGGCTAAAAAGTCACATTAATCCTACT

GGTACGGTATTGTTGCAATTGGAGAACACAATGCAAATGTCTTTGAAAGATTTGTTA

Polynucleotide sequence of Variant No. 218 hCDS:
(SEQ ID NO: 12)
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

-continued

```
GCTGTAGCTATTATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATAACTGGACTTCAAGGTTAAAAAGTCACATAAATCC

CACAGGCACTGTTTTGCTTCAGCTAGAAAATACAATGCAGATGTCATTAAAAGACTTACT

T
```

Polypeptide sequence of Variant No. 218:
(SEQ ID NO: 13)

```
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSFNQERIVDVAGPGGWNDPDMLVIGNFG

LSWNQQVTQMALWAIMAAPLFMSNDLRHISPQAKALLQDKDVIAINQDPLGKQGYQLRQG

DNFEVWERPLSGLAWAVAIINRQEIGGPRSYTIAVASLGKGVACNPACFITQLLPVKRKLGFY

NVVTSRLKSHINPTGTVLLQLENTMQMSLKDLL
```

Polynucleotide sequence of Variant No. 326 yCDS:
(SEQ ID NO: 14)

```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACGGATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGCACCCCTATTCATGTCTAATGATCTACGTCACATATCACCCCAAGCAAAGGCTTT

ACTTCAAGATAAGGATGTCATAGCGATCAACCAAGATCCTCTTGGTAAACAAGGTTATCA

ATTGAGAAAAGGTGACAACTTTGAAGTGTGGGAAAGACCATTGTCTGGAGATGCGTGGG

CTGTTGCTATTATCAACCGTCAAGAGATCGGAGGGCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACTGGACCTCTAGGCTAAAAAGTCACATTAATCCTAC

TGGTACGGTATTGTTGCAATTGGAGAACACAATGCAAATGTCTTTGAAAGATTTGTTA
```

Polypeptide sequence of Variant No. 326:
(SEQ ID NO: 15)

```
LDNGLARTPTMGWLHWERFMCNLDCQEEPDSCISEKLFMEMAERMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSRNQERIVDVAGPGGWNDPDMLVIGNF

GLSWDQQVTQMALWAIMAAPLFMSNDLRHISPQAKALLQDKDVIAINQDPLGKQGYQLRK
```

GDNFEVWERPLSGDAWAVAIINRQEIGGPRSYTIPVASLGKGVACNPACFITQLLPVKRQLGF

YNVVTSRLKSHINPTGTVLLQLENTMQMSLKDLL

Polynucleotide sequence of Variant No. 206 yCDS:

(SEQ ID NO: 16)

TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATAATTGGACCTCTAGGCTAAGAAGTCACATCAATCCTACT

GGTACGGTATTGTTGCAATTGGAGAACACAATGCAAATGTCTTTGAAAGATTTGTTA

Polynucleotide sequence of Variant No. 206 hCDS:

(SEQ ID NO: 17)

CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

-continued

```
GCTTCCCTGGGTAAAGGAGTGGCCTGTAATCCTGCCTGCTTCATCACACAGCTCCTCCCT

GTGAAAAGGAAGCTAGGGTTCTATAACTGGACTTCAAGGTTAAGAAGTCACATAAATCC

CACAGGCACTGTTTTGCTTCAGCTAGAAAATACAATGCAGATGTCATTAAAAGACTTACT

T
```

Polypeptide sequence of Variant No. 206:

(SEQ ID NO: 18)

```
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSFNQERIVDVAGPGGWNDPDMLVIGNFG

LSWNQQVTQMALWAIMAAPLFMSNDLRHISPQAKALLQDKDVIAINQDPLGKQGYQLRQG

DNFEVWERPLSGLAWAVAMINRQEIGGPRSYTIAVASLGKGVACNPACFITQLLPVKRKLGF

YNWTSRLRSHINPTGTVLLQLENTMQMSLKDLL
```

Polynucleotide sequence of Variant No. 205 yCDS:

(SEQ ID NO: 19)

```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC

CTCTTTGGGTAAGGGTGTTGCGTGCAATCCTGCCTGCTTCATTACACAATTGCTTCCAGTT

AAGAGAAAGTTGGGTTTCTATGATTGGGACTCTAGGCTAAGAAGTCACATCAATCCTACT

GGTACGGTATTGTTGCAATTGGAGAACACAATGCAAATGTCTTTGAAAGATTTGTTA
```

Polynucleotide sequence of Variant No. 205 hCDS:

(SEQ ID NO: 20)

```
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG
```

-continued

```
ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGGCGAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATGATTGGGATTCAAGGTTAAGAAGTCACATAAATCC

CACAGGCACTGTTTTGCTTCAGCTAGAAAATACAATGCAGATGTCATTAAAAGACTTACT

T
```

Polypeptide sequence of Variant No. 205:

(SEQ ID NO: 21)

```
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSFNQERIVDVAGPGGWNDPDMLVIGNFG

LSWNQQVTQMALWAIMAAPLFMSNDLRHISPQAKALLQDKDVIAINQDPLGKQGYQLRQG

DNFEVWERPLSGLAWAVAMINRQEIGGPRSYTIAVASLGKGVACNPACFITQLLPVKRKLGF

YDWDSRLRSHINPTGTVLLQLENTMQMSLKDLL
```

Polynucleotide sequence of Variant No. 76 yCDS:

(SEQ ID NO: 22)

```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACTAATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAGGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGAGGTCAATCAAATCTATCTTGGATTGGACTTCTTTCAACCAG

GAAAGAATTGTTGATGTTGCAGGTCCAGGTGGATGGAATGACCCTGATATGCTTGTCATA

GGGAACTTTGGGCTATCATGGAATCAACAAGTTACACAAATGGCTTTGTGGGCGATCATG

GCCGCACCCCTATTCATGTCTAATGATCTACGTCACATATCACCCCAAGCAAAGGCTTTA

CTTCAAGATAAGGATGTCATAGCGATCAACCAAGATCCTCTTGGTAAACAAGGTTATCAA

TTGAGACAAGGTGACAACTTTGAAGTGTGGGAAAGACCATTGTCTGGACTTGCGTGGGC

TGTTGCTATGATCAACCGTCAAGAGATCGGAGGGCCAAGATCTTACACTATCGCGGTAGC
```

```
CTCTTTGGGTAAGGGTGTTGCGTGCAATCCTGCCTGCTTCATTACACAATTGCTTCCAGTT

AAGAGAAAGTTGGGTTTCTATGAGTGGACATCTAGGCTAAGAAGTCACATCAATCCTACT

GGTACGGTATTGTTGCAATTGGAGAACACAATGCAAATGTCTTTGAAAGATTTGTTA
```

Polynucleotide sequence of Variant No. 76 hCDS:
(SEQ ID NO: 23)
```
CTGGACAATGGATTGGCAAGGACGCCTACCATGGGCTGGCTGCACTGGGAGCGCTTCAT

GTGCAACCTTGACTGCCAGGAAGAGCCAGATTCCTGCATCAGTGAGAAGCTCTTCATGG

AGATGGCAGAGCTCATGGTCTCAGAAGGCTGGAAGGATGCAGGTTATGAGTACCTCTGC

ATTGATGACTGTTGGATGGCTCCCCAAAGAGATTCAGAAGGCAGACTTCAGGCAGACCC

TCAGCGCTTTCCTCATGGGATTCGCCAGCTAGCTAATTATGTTCACAGCAAAGGACTGAA

GCTAGGGATTTATGCAGATGTTGGAAATAAAACCTGCGCAGGCTTCCCTGGGAGTTTTGG

ATACTACGACATTGATGCCCAGACCTTTGCTGACTGGGGAGTAGATCTGCTAAAATTTGA

TGGTTGTTACTGTGACAGTTTGGAAAATTTGGCAGATGGTTATAAGCACATGTCCTTGGC

CCTGAATAGGACTGGCAGAAGCATTGTGTACTCCTGTGAGTGGCCTCTTTATATGTGGCC

CTTTCAAAAGCCCAATTATACAGAAATCCGACAGTACTGCAATCACTGGCGAAATTTTGC

TGACATTGATGATTCCTGGCGTAGTATAAAGAGTATCTTGGACTGGACATCTTTTAACCA

GGAGAGAATTGTTGATGTTGCTGGACCAGGGGGTTGGAATGACCCAGATATGTTAGTGA

TTGGCAACTTTGGCCTCAGCTGGAATCAGCAAGTAACTCAGATGGCCCTCTGGGCTATCA

TGGCTGCTCCTTTATTCATGTCTAATGACCTCCGACACATCAGCCCTCAAGCCAAAGCTCT

CCTTCAGGATAAGGACGTAATTGCCATCAATCAGGACCCCTTGGGCAAGCAAGGGTACC

AGCTTAGACAGGGAGACAACTTTGAAGTGTGGGAACGACCTCTCTCAGGCTTAGCCTGG

GCTGTAGCTATGATAAACCGGCAGGAGATTGGTGGACCTCGCTCTTATACCATCGCAGTT

GCTTCCCTGGGTAAAGGAGTGGCCTGTAATCCTGCCTGCTTCATCACACAGCTCCTCCCT

GTGAAAAGGAAGCTAGGGTTCTATGAATGGACTTCAAGGTTAAGAAGTCACATAAATCC

CACAGGCACTGTTTTGCTTCAGCTAGAAAATACAATGCAGATGTCATTAAAAGACTTACT

T
```

Polypeptide sequence of Variant No. 76:
(SEQ ID NO: 24)
```
LDNGLARTPTMGWLHWERFMCNLDCQEEPDSCISEKLFMEMAELMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWRSIKSILDWTSFNQERIVDVAGPGGWNDPDMLVIGNFG

LSWNQQVTQMALWAIMAAPLFMSNDLRHISPQAKALLQDKDVIAINQDPLGKQGYQLRQG

DNFEVWERPLSGLAWAVAMINRQEIGGPRSYTIAVASLGKGVACNPACFITQLLPVKRKLGF

YEWTSRLRSHINPTGTVLLQLENTMQMSLKDLL
```

Polynucleotide sequence of Mfalpha signal peptide:
(SEQ ID NO: 25)
ATGAGATTTCCTTCAATTTTTACTGCAGTTTTATTCGCAGCATCCTCCGCATTAGCT Polypeptide sequence of Mfalpha signal peptide:
(SEQ ID NO: 26)
MRFPSIFTAVLFAASSALA Polynucleotide sequence of MMO435:
(SEQ ID NO: 27)
ttaactatatcgtaatacacaggatccaccATGAGATTTCCTTCAATTTTTACTG -continued Polynucleotide sequence of MM0439:
(SEQ ID NO: 28)
AGTAGGTGTACGGGCTAACCCGTTATCCAAAGCTAATGCGGAGGATGC Polynucleotide sequence of MM0514:
(SEQ ID NO: 29)
TTTTACTGCAGTTTTATTCGCAGCATCCTCCGCATTAGCTTTGGATAACGGGTTAGCCCG Polynucleotide sequence of MM0481:
(SEQ ID NO: 30)
GAGCTAAAAGTACAGTGGGAACAAAGTCGAGGTCGACTTATAACAAATCTTTCAAAGAC

A

Polynucleotide sequence of Synthetic mammalian signal peptide:
(SEQ ID NO: 31)
ATGGAATGGAGCTGGGTCTTTCTCTTCTTCCTGTCAGTAACGACTGGTGTCCACTCC Polynucleotide sequence of LAKE Fw:
(SEQ ID NO. 32)
CGATCGAAGCTTCGCCACCA Polynucleotide sequence of Br reverse:
(SEQ ID NO: 33)
CTTGCCAATCCATTGTCCAGGGAGTGGACACCAGTCGTTA Polynucleotide sequence of Br Fw:
(SEQ ID NO: 34)
TAACGACTGGTGTCCACTCCCTGGACAATGGATTGGCAAG Polynucleotide sequence of hGLA Rv:
(SEQ ID NO: 35)
CGATCGGCGGCCGCTCAAAGTAAGTCTTTTAATGACA Polynucleotide sequence of SP-GLA (yCDS):
(SEQ ID NO: 36)
ATGAGATTTCCTTCAATTTTTACTGCAGTTTTATTCGCAGCATCCTCCGCATTAGCTTTGG

ATAACGGGTTAGCCCGTACACCTACTATGGGTTGGCTTCACTGGGAAAGATTCATGTGTA

ACTTAGATTGCCAAGAAGAGCCTGACAGCTGTATCTCAGAGAAACTATTCATGGAGATG

GCTGAACTAATGGTAAGTGAAGGATGGAAGGATGCTGGTTATGAATACCTATGTATTGA

TGATTGCTGGATGGCTCCACAGCGTGATTCAGAAGGTAGGTTACAAGCTGACCCCCAGA

GATTCCCACATGGCATACGTCAGCTTGCAAACTACGTACACAGCAAGGGTCTAAAGTTA

GGCATCTACGCTGATGTCGGAAACAAGACATGTGCTGGTTTCCCAGGTTCATTCGGTTAC

TATGACATAGATGCGCAGACGTTTGCTGATTGGGGTGTTGATTTGTTGAAGTTTGATGGA

TGCTACTGCGATTCCCTGGAGAACCTAGCCGATGGGTACAAACACATGAGTTTGGCTCTA

AACAGGACTGGTAGGAGCATCGTCTATAGTTGTGAATGGCCCTTGTACATGTGGCCGTTT

CAGAAGCCAAACTACACTGAGATAAGACAATACTGTAACCATTGGCGTAACTTTGCTGA

CATAGATGATTCATGGAAGTCAATCAAATCTATCTTGGATTGGACTTCTTTCAACCAGGA

AAGAATTGTTGATGTTGCAGGTCCAGGTGGATGGAATGACCCTGATATGCTTGTCATAGG

GAACTTTGGGCTATCATGGAATCAACAAGTTACACAAATGGCTTTGTGGGCGATCATGGC

CGCACCCCTATTCATGTCTAATGATCTACGTCACATATCACCCCAAGCAAAGGCTTTACT

TCAAGATAAGGATGTCATAGCGATCAACCAAGATCCTCTTGGTAAACAAGGTTATCAATT

GAGACAAGGTGACAACTTTGAAGTGTGGGAAAGACCATTGTCTGGACTTGCGTGGGCTG

TTGCTATGATCAACCGTCAAGAGATCGGAGGGCCAAGATCTTACACTATCGCGGTAGCCT

CTTTGGGTAAGGGTGTTGCGTGCAATCCTGCCTGCTTCATTACACAATTGCTTCCAGTTAA

GAGAAAGTTGGGTTTCTATGAGTGGACATCTAGGCTAAGAAGTCACATCAATCCTACTGG

TACGGTATTGTTGCAATTGGAGAACACAATGCAAATGTCTTTGAAAGATTTGTTA

Polynucleotide Sequence of MFleader-GLA (yCDS):
(SEQ ID NO: 37)
ATGAGATTTCCTTCAATTTTTACTGCAGTTTTATTCGCAGCATCCTCCGCATTAGCTGCTC

CAGTCAACACTACAACAGAAGATGAAACGGCACAAATTCCGGCTGAAGCTGTCATCGGT

TACTTAGATTTAGAAGGGGATTTCGATGTTGCTGTTTTGCCATTTTCCAACAGCACAAAT

AACGGGTTATTGTTTATAAATACTACTATTGCCAGCATTGCTGCTAAAGAAGAAGGGGTA

TCTTTGGATAAAAGATTGGATAACGGGTTAGCCCGTACACCTACTATGGGTTGGCTTCAC

TGGGAAAGATTCATGTGTAACTTAGATTGCCAAGAAGAGCCTGACAGCTGTATCTCAGA

GAAACTATTCATGGAGATGGCTGAACTAATGGTAAGTGAAGGATGGAAGGATGCTGGTT

ATGAATACCTATGTATTGATGATTGCTGGATGGCTCCACAGCGTGATTCAGAAGGTAGGT

TACAAGCTGACCCCCAGAGATTCCCACATGGCATACGTCAGCTTGCAAACTACGTACACA

GCAAGGGTCTAAAGTTAGGCATCTACGCTGATGTCGGAAACAAGACATGTGCTGGTTTCC

CAGGTTCATTCGGTTACTATGACATAGATGCGCAGACGTTTGCTGATTGGGGTGTTGATT

TGTTGAAGTTTGATGGATGCTACTGCGATTCCCTGGAGAACCTAGCCGATGGGTACAAAC

ACATGAGTTTGGCTCTAAACAGGACTGGTAGGAGCATCGTCTATAGTTGTGAATGGCCCT

TGTACATGTGGCCGTTTCAGAAGCCAAACTACACTGAGATAAGACAATACTGTAACCATT

GGCGTAACTTTGCTGACATAGATGATTCATGGAAGTCAATCAAATCTATCTTGGATTGGA

CTTCTTTCAACCAGGAAAGAATTGTTGATGTTGCAGGTCCAGGTGGATGGAATGACCCTG

ATATGCTTGTCATAGGGAACTTTGGGCTATCATGGAATCAACAAGTTACACAAATGGCTT

TGTGGGCGATCATGGCCGCACCCCTATTCATGTCTAATGATCTACGTCACATATCACCCC

AAGCAAAGGCTTTACTTCAAGATAAGGATGTCATAGCGATCAACCAAGATCCTCTTGGTA

AACAAGGTTATCAATTGAGACAAGGTGACAACTTTGAAGTGTGGGAAAGACCATTGTCT

GGACTTGCGTGGGCTGTTGCTATGATCAACCGTCAAGAGATCGGAGGGCCAAGATCTTA

CACTATCGCGGTAGCCTCTTTGGGTAAGGGTGTTGCGTGCAATCCTGCCTGCTTCATTAC

ACAATTGCTTCCAGTTAAGAGAAAGTTGGGTTTCTATGAGTGGACATCTAGGCTAAGAAG

TCACATCAATCCTACTGGTACGGTATTGTTGCAATTGGAGAACACAATGCAAATGTCTTT

GAAAGATTTGTTA

Polypeptide Sequence of MFleader:
(SEQ ID NO: 38)
MRFPSIFTAVLFAASSALAAPVNTTTEDETAQIPAEAVIGYLDLEGDFDVAVLPFSNSTNNGLL

FINTTIASIAAKEEGVSLDKR

Polynucleotide sequence of Variant No. 395 yCDS:
(SEQ ID NO: 39)
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACGGATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACCATGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGAGCATCGTCTATAGTTGTGAATGGCCCTTGTACATGTGGCCG

TTTCAGAAGCCAAACTACACTGAGATAAGACAATACTGTAACCATTGGCGTAACTTTGCT

-continued
```
GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGCACCCCTATTCATGTCTAATGATCTACGTCACATATCACCCCAAGCAAAGGCTTT

ACTTCAAGATAAGGATGTCATAGCGATCAACCAAGATCCTCTTGGTAAACAAGGTTATCA

ATTGAGAAAGGTGACAACTTTGAAGTGTGGGAAAGACCATTGTCTGGAGATGCGTGGG

CTGTTGCTATTATCAACCGTCAAGAGATCGGAGGGCCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACTGGACCTCTAGGCTAAAAAGTCACATTAATCCTAC

TGGTACGGTATTGTTGCAATTGGAGAACACAATGCAAATGTCTTTGAAAGATTTGTTA
```

Polypeptide sequence of Variant No. 395:
(SEQ ID NO: 40)
```
LDNGLARTPTMGWLHWERFMCNLDCQEEPDSCISEKLFMEMAERMVSEGWKDAGYEYLCI

DDCWMAPQRDSEGRLQADPQRFPHGIRQLANHVHSKGLKLGIYADVGNKTCAGFPGSFGYY

DIDAQTFADWGVDLLKFDGCYCDSLENLADGYKHMSLALNRTGRSIVYSCEWPLYMWPFQ

KPNYTEIRQYCNHWRNFADIDDSWASIKSILDWTSRNQERIVDVAGPGGWNDPDMLVIGNF

GLSWDQQVTQMALWAIMAAPLFMSNDLRHISPQAKALLQDKDVIAINQDPLGKQGYQLRK

GDNFEVWERPLSGDAWAVAIINRQEIGGPRSYTIPVASLGKGVACNPACFITQLLPVKRQLGF

YNVVTSRLKSHINPTGTVLLQLENTMQMSLKDLL
```

Polynucleotide sequence of Variant No. 402 yCDS:
(SEQ ID NO: 41)
```
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACGGATGGTAAGTGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACTACGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGCCGATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGCACCCCTATTCATGTCTAATGATCTACGTCACATATCACCCCAAGCAAAGGCTTT

ACTTCAAGATAAGGATGTCATAGCGATCAACCAAGATCCTCTTGGTAAACAAGGTTATCA

ATTGAGAAAGGTGACAACTTTGAAGTGTGGGAAAGACCATTGTCTGGAGATGCGTGGG

CTGTTGCTATTATCAACCGTCAAGAGATCGGAGGGCCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACTGGACCTCTAGGCTAAAAAGTCACATTAATCCTAC

TGGTACGGTATTGTTGCAATTGGAGAACACAATGCAAATGTCTTTGAAAGATTTGTTA
```

Polypeptide sequence of Variant No. 402:
(SEQ ID NO: 42)
LDNGLARTPTMGWLHWERFMCNLDCQEEPDSCISEKLFMEMAERMVSEGWKDAGYEYLCI

DDCWMAPQRDSEGRLQADPQRFPHGIRQLANYVHSKGLKLGIYADVGNKTCAGFPGSFGYY

DIDAQTFADWGVDLLKFDGCYCDSLENLADGYKHMSLALNRTGRPIVYSCEWPLYMWPFQ

KPNYTEIRQYCNHWRNFADIDDSWASIKSILDWTSRNQERIVDVAGPGGWNDPDMLVIGNF

GLSWDQQVTQMALWAIMAAPLFMSNDLRHISPQAKALLQDKDVIAINQDPLGKQGYQLRK

GDNFEVWERPLSGDAWAVAIINRQEIGGPRSYTIPVASLGKGVACNPACFITQLLPVKRQLGF

YNVVTSRLKSHINPTGTVLLQLENTMQMSLKDLL

Polynucleotide sequence of Variant No. 625 yCDS:
(SEQ ID NO: 43)
TTGGATAACGGGTTAGCCCGTACACCTACTATGGGTTGGCTTCACTGGGAAAGATTCATG

TGTAACTTAGATTGCCAAGAAGAGCCTGACAGCTGTATCTCAGAGAAACTATTCATGGA

GATGGCTGAACGGATGGTAACCGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACCATGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGCCGATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGCACCCCTATTCATGTCTAATGATCTACGTGCGATATCACCCCAAGCAAAGGCTTT

ACTTCAAGATAAGGATGTCATAGCGATCAACCAAGATCCTCTTGGTAAACAAGGTTATCA

ATTGAGAAAAGGTGACAACTTTGAAGTGTGGGAAAGACCATTGTCTGGAGATGCGTGGG

CTGTTGCTATTATCAACCGTCAAGAGATCGGAGGGCCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACTGGACCTCTAGGCTAAAAAGTCACATTAATCCTAC

TGGTACGGTATTGTTGCAATTGGAGAACACAATGCAAACCTCTTTGAAAGATTTGTTA

Polypeptide sequence of Variant No. 625:
(SEQ ID NO: 44)
LDNGLARTPTMGWLHWERFMCNLDCQEEPDSCISEKLFMEMAERMVTEGWKDAGYEYLCI

DDCWMAPQRDSEGRLQADPQRFPHGIRQLANHVHSKGLKLGIYADVGNKTCAGFPGSFGYY

DIDAQTFADWGVDLLKFDGCYCDSLENLADGYKHMSLALNRTGRPIVYSCEWPLYMWPFQ

KPNYTEIRQYCNHWRNFADIDDSWASIKSILDWTSRNQERIVDVAGPGGWNDPDMLVIGNF

GLSWDQQVTQMALWAIMAAPLFMSNDLRAISPQAKALLQDKDVIAINQDPLGKQGYQLRK

GDNFEVWERPLSGDAWAVAIINRQEIGGPRSYTIPVASLGKGVACNPACFITQLLPVKRQLGF

YNVVTSRLKSHINPTGTVLLQLENTMQTSLKDLL

Polynucleotide sequence of Variant No. 648 yCDS:
(SEQ ID NO: 45)
TTGGATAACGGGTTAGCCCGTACACCTCCGATGGGTTGGCTTCACTGGGAAAGATTCATG

TGTAACTTAGATTGCCAAGAAGAGCCTGACAGCTGTATCTCAGAGAAACTATTCGAAGA

```
                                -continued
GATGGCTGAACGGATGGTAACCGAAGGATGGAAGGATGCTGGTTATGAATACCTATGTA

TTGATGATTGCTGGATGGCTCCACAGCGTGATTCAGAAGGTAGGTTACAAGCTGACCCCC

AGAGATTCCCACATGGCATACGTCAGCTTGCAAACCATGTACACAGCAAAGGTCTAAAG

TTAGGCATCTACGCTGATGTCGGAAACAAGACATGTGCTGGTTTCCCAGGTTCATTCGGT

TACTATGACATAGATGCGCAGACGTTTGCTGATTGGGGTGTTGATTTGTTGAAGTTTGAT

GGATGCTACTGCGATTCCCTGGAGAACCTAGCCGATGGGTACAAACACATGAGTTTGGCT

CTAAACAGGACTGGTAGGCCGATCGTCTATAGTTGTGAATGGCCCTTGTACATGTGGCCG

TTTCAGAAGCCAAACTACACTGAGATAAGACAATACTGTAACCATTGGCGTAACTTTGCT

GACATAGATGATTCATGGGCTTCAATCAAATCTATCTTGGATTGGACTTCTCGTAACCAG

GAAAGAATTGTTGATGTTGCAGGTCCAGGTGGATGGAATGACCCTGATATGCTTGTCATA

GGGAACTTTGGGCTATCATGGGACCAACAAGTTACACAAATGGCTTTGTGGGCGATCAT

GGCCGGCCCCCTATTCATGTCTAATGATCTACGTGCGATATCACCCCAAGCAAAGGCTTT

ACTTCAAGATAAGGATGTCATAGCGATCAACCAAGATCCTCTTGGTAAACAAGGTTATCA

ATTGAGAAAAGGTGACAACTTTGAAGTGTGGGAAAGACCATTGTCTGGAGATGCGTGGG

CTGTTGCTATTATCAACCGTCAAGAGATCGGAGGGCCAAGATCTTACACTATCCCGGTAG

CCTCTTTGGGTAAGGGTGTTGCGTGCAATCCTGCCTGCTTCATTACACAATTGCTTCCAGT

TAAGAGACAATTGGGTTTCTATAACGCAACCTCTAGGCTAAAAAGTCACATTAATCCTAC

TGGTACGGTATTGTTGCAATTGGAGAACACAATGCAAACCTCTTTGAAAGATTTGTTA

Polypeptide sequence of Variant No. 648:
                                                    (SEQ ID NO: 46)
LDNGLARTPPMGWLHWERFMCNLDCQEEPDSCISEKLFEEMAERMVTEGWKDAGYEYLCI

DDCWMAPQRDSEGRLQADPQRFPHGIRQLANHVHSKGLKLGIYADVGNKTCAGFPGSFGYY

DIDAQTFADWGVDLLKFDGCYCDSLENLADGYKHMSLALNRTGRPIVYSCEWPLYMWPFQ

KPNYTEIRQYCNHWRNFADIDDSWASIKSILDWTSRNQERIVDVAGPGGWNDPDMLVIGNF

GLSWDQQVTQMALWAIMAGPLFMSNDLRAISPQAKALLQDKDVIAINQDPLGKQGYQLRK

GDNFEVWERPLSGDAWAVAIINRQEIGGPRSYTIPVASLGKGVACNPACFITQLLPVKRQLGF

YNATSRLKSHINPTGTVLLQLENTMQTSLKDLL
```

Example 1

GLA Gene Acquisition and Construction of Expression Vectors

A synthetic gene coding for a WT human GLA was designed for optimized gene expression in *Saccharomyces cerevisiae* (SEQ ID NO:3), assembled, and subcloned into the *E. coli* expression vector pCK100900i (SEQ ID NO:6).

A chimeric GLA expression construct encoding a 19 amino acid *S. cerevisae* MFalpha signal peptide fused to the mature form of yeast-optimized GLA was generated in a yeast expression vector designed for secreted expression, as follows. A fragment coding for the MFalpha signal peptide (SEQ ID NO:25) was amplified by PCR using the oligonucleotides MM0435 (SEQ ID NO:27) and MM0439 (SEQ ID NO:28) from S288C genomic DNA, and a fragment coding for a synthetic GLA (SEQ ID NO:3) was amplified using primers MM0514 (SEQ ID NO:29) and MM0481 (SEQ ID NO:30). Additional sequence at the 5' ends of these oligonucleotides provide homology for yeast recombination cloning when cotransformed with linearized plasmid pYT-72Bgl (SEQ ID NO:7). In the resulting vector, the expression of fusion protein SP-GLA (SEQ ID NO:36) is driven by the ADH2 promoter. A fusion construct encoding a fusion of an 83 amino acid MFalpha leader peptide (SEQ ID NO:38) N-terminally fused to GLA (SEQ ID NO:37) was cloned using the same techniques. Recombination cloning and gene expression were performed in *S. cerevisiae* strain INVSc1. Directed evolution techniques generally known by those skilled in the art were used to generate libraries of gene variants from this plasmid construct (See e.g., U.S. Pat. No. 8,383,346 and WO2010/144103).

A chimeric GLA expression construct encoding a synthetic signal peptide fused to a synthetic gene coding for the mature human GLA coding sequence for secreted expression in transient transfections was generated as follows. Oligonucleotides PLEV113Fw (SEQ ID NO:32) and SPGLARv (SEQ ID NO:33) were used to amplify a fragment coding for a synthetic signal peptide (SEQ ID NO:31) using PCR. A second fragment coding for the native human coding sequence for the mature form of GLA (SEQ ID NO:4) was amplified using oligonucleotides SPGLAFw (SEQ ID NO:34) and GLARv (SEQ ID NO:35). Splicing by Overlap Extension PCR was used to recombine these fragments, and the resulting chimeric fragment was ligated into the HindIII/

Not I linearized mammalian expression vector pLEV113. Directed evolution techniques generally known by those skilled in the art were used to generate specific gene variants from this plasmid construct.

Example 2

High-Throughput Growth and Assays

High-Throughput (HTP) Growth of GLA and GLA Variants

Yeast (INVSc1) cells transformed with vectors expressing GLA and GLA variants using the lithium acetate method were selected on SD-Ura agar plates. After 72 h incubation at 30° C. colonies were placed into the wells of Axygen® 1.1 ml 96-well deep well plates filled with 200 µl/well SD-Ura broth (2 g/L SD-Ura, 6.8 g/L yeast nitrogen base without amino acids [Sigma Aldrich]), 3.06 g/L sodium dihydrogen phosphate, 0.804 g/L disodium hydrogen phosphate, pH 6.0 supplemented with 6% glucose. The cells were allowed to grow for 20-24 hours in a Kuhner shaker (250 rpm, 30° C., and 85% relative humidity). Overnight culture samples (20 µL) were transferred into Corning Costar® 96-well deep plates filled with 380 µL of SD-ura broth supplemented with 2% glucose. The plates were incubated for 66-84 h in a Kuhner shaker (250 rpm, 30° C., and 85% relative humidity). The cells were then pelleted (4000 rpm×20 min), and the supernatants isolated and stored at 4° C. prior to analysis.

HTP-Analysis of Supernatants

GLA variant activity was determined by measuring the hydrolysis of 4-methylumbelliferyl α-D-galactopyranoside (MUGal). For this assay, 5-50 µL of yeast culture supernatant produced as described above, was mixed with 0-45 µL of McIlvaine Buffer (McIlvaine, J. Biol. Chem., 49:183-186 [1921]), pH 4.8 and 50 µL of 2 mM MUGal in 50 mM citrate, 200 mM KCl, pH 4.6 in a 96-well, black, opaque bottom plate. The reactions were mixed briefly and incubated at 37° C. for 30-180 minutes, prior to quenching with 100 µL of 1 M sodium carbonate. Hydrolysis was analyzed using a SpectraMax® M2 microplate reader monitoring fluorescence (Ex. 355 nm, Em. 448 nm).

HTP-Analysis of Supernatants Pretreated with Acid

GLA variants were challenged with acidic buffer to simulate the extreme pHs that the variants may encounter in lysosomes. First, 50 µL of yeast culture supernatant and 50 uL of McIlvaine buffer (pH 3.3-4.3) were added to the wells of a 96-well round bottom plate. The plates were sealed with a PlateLoc Thermal Microplate Sealer (Agilent) and incubated at 37° C. for 1-3 h. For the assay, 10-50 µL of acid-pH-challenged sample was mixed with 0-40 µL of McIlvaine buffer pH 4.8, 25 µL of 1 M citrate buffer pH 4.3 and 25 µL of 4 mM MUGal in McIlvaine buffer pH 4.8. The reactions were mixed briefly and incubated at 37° C. for 30-180 minutes, prior to quenching with 100 µL of 1 M sodium carbonate. Hydrolysis was analyzed using a SpectraMax® M2 microplate reader monitoring fluorescence (Ex. 355 nm, Em. 448 nm).

HTP-Analysis of Supernatants Pretreated with Base

GLA variants were challenged with basic (neutral) buffer to simulate the pHs that the variants encounter in the blood following their administration to a patient. First, 50 µL of yeast culture supernatant and 50 uL of McIlvaine buffer (pH 7.0-8.2) or 200 mM sodium bicarbonate (pH 9.1-9.7) were added to the wells of a 96-well round bottom plate. The plates were sealed and incubated at 37° C. for 1-18 h. For the assay, 10-50 µL of basic-pH-challenged sample was mixed with 0-40 µL of McIlvaine buffer pH 4.8, 25 µL of 1 M citrate buffer pH 4.3 and 25 µL of 4 mM MUGal in McIlvaine buffer pH 4.8. The reactions were mixed briefly and incubated at 37° C. for 30-180 minutes, prior to quenching with 100 µL of 1 M sodium carbonate. Hydrolysis was analyzed using a SpectraMax® M2 microplate reader monitoring fluorescence (Ex. 355 nm, Em. 448 nm).

HTP-Analysis of Supernatants Pretreated with Bovine Serum

GLA variants were challenged with bovine serum to simulate the conditions the variants encounter following infusion into a patient. First, 20 µL of yeast culture supernatant and 80 µL of bovine serum were added to the wells of a 96-well round bottom plate. The plates were sealed and incubated at 37° C. for 1 h. For the assay, 50 µL of serum-challenged sample was mixed with 25 µL of 1 M citrate buffer pH 4.3 and 25 µL of 4 mM MUGal in McIlvaine buffer pH 4.8. The reactions were mixed briefly and incubated at 37° C. for 180 minutes, prior to quenching with 100 µL of 1 M sodium carbonate. Hydrolysis was analyzed using a SpectraMax® M2 microplate reader monitoring fluorescence (Ex. 355 nm, Em. 448 nm).

TABLE 2.1

Relative Activity of GLA Variants After No Challenge (NC) or Challenge at the Indicated pH[1,2]

| Variant # | NC | pH 4.3 | pH 7.0 | Amino Acid Differences Relative to SEQ ID NO: 5 | SEQ ID NO: |
|---|---|---|---|---|---|
| 1 | + | + | + | A337S | 47 |
| 2 | + | + | + | E43D | 48 |
| 3 | + | + | + | E43D/E48D | 49 |
| 4 | + | +++ | + | E43D/E48D/I208V/N247D/Q299R/Q302K/R373K/I376V | 50 |
| 5 | ++ | ++ | ++ | E43D/E48D/I208V/R373K | 51 |
| 6 | + | +++ | + | E43D/E48D/I208V/R373K/I376V | 52 |
| 7 | + | ++ | + | E43D/E48D/N247D/Q299R/Q302K/R373K/I376V | 53 |
| 8 | ++ | +++ | +++ | E43D/E48D/N247D/Q302K/R373K | 54 |
| 9 | + | +++ | + | E43D/E48D/Q302K/R373K/I376V | 55 |
| 10 | ++ | +++ | ++ | E43D/I208V/N247D | 56 |
| 11 | + | +++ | ++ | E43D/I208V/N247D/Q299R/R373K/I376V | 57 |
| 12 | + | ++ | + | E43D/I208V/Q299R/R373K/I376V | 58 |
| 13 | ++ | +++ | ++ | E43D/N247D/R373K/I376V | 59 |
| 14 | + | +++ | ++ | E43D/R373K/I376V | 60 |
| 15 | + | + | + | E48D/I208V/Q299R/Q302K/R373K | 61 |
| 16 | + | ++ | + | E48D/R373K/I376V | 62 |
| 17 | + | + | + | E48G/R373K | 63 |
| 18 | + | + | ++ | F217S | 64 |

TABLE 2.1-continued

Relative Activity of GLA Variants After No Challenge (NC) or Challenge at the Indicated pH[1,2]

| Variant # | NC | pH 4.3 | pH 7.0 | Amino Acid Differences Relative to SEQ ID NO: 5 | SEQ ID NO: |
|---|---|---|---|---|---|
| 19 | + | ++ | + | I208V/N247D/Q299R/Q302K/R373K/I376V | 65 |
| 20 | + | +++ | ++ | I208V/N247D/Q299R/R373K/I376V | 66 |
| 21 | + | +++ | ++ | I208V/N247D/R373K/I376V | 67 |
| 22 | + | + | + | I208V/Q299R/I376V | 68 |
| 23 | + | +++ | ++ | I208V/Q302K/R373K/I376V | 69 |
| 24 | + | ++ | + | I376V | 70 |
| 25 | + | + | + | K36Q | 71 |
| 26 | + | + | + | P179S/R373K | 72 |
| 27 | + | + | + | Q299R/M322V/R373K | 73 |
| 28 | + | + | + | Q299R/Q302K/R373K | 74 |
| 29 | + | + | + | Q299R/Q302K/R373K/I376V | 75 |
| 30 | + | ++ | + | Q302K/I376V | 76 |
| 31 | + | + | + | R373K | 77 |
| 32 | + | ++ | + | R373K/I376V | 78 |

[1]Relative activity was calculated as activity of the variant/activity of WT GLA (SEQ ID NO: 5 (encoded by SEQ ID NO: 3).
[2]+ = 0.5 to 1.5 relative activity over WT GLA (SEQ ID NO: 5); ++ = >1.5 to 2.5 relative activity over WT GLA (SEQ ID NO: 5); and +++ = >2.5 relative activity over WT GLA (SEQ ID NO: 5).

TABLE 2.2

Relative Activity of GLA Variants After No Challenge (NC) or Challenge at the Indicated pH[1,2,3]

| Variant # | NC | pH 4.2 | pH 7.1 | Amino Acid Differences Relative to SEQ ID NO: 5 | SEQ ID NO: |
|---|---|---|---|---|---|
| 33 | + | + | + | A199H/E367S | 79 |
| 34 | + | ++ | ++ | A337P | 80 |
| 35 | ++ | ++ | ++ | A339S | 81 |
| 36 | + | ++ | ++ | A350G | 82 |
| 37 | + | + | + | D105A | 83 |
| 38 | – | + | – | D105S | 84 |
| 39 | + | ++ | ++ | D124N/E147G/N161K/R162Q/T163V/R165A/I167S/ V168I/Y169V/S170—/M177S/F217E | 85 |
| 40 | ++ | ++ | ++ | D396R | 86 |
| 41 | + | + | + | D396T | 87 |
| 42 | +++ | +++ | +++ | E367N | 88 |
| 43 | + | + | + | E367T | 89 |
| 44 | + | ++ | + | E387K | 90 |
| 45 | ++ | ++ | ++ | E387Q | 91 |
| 46 | + | +++ | + | E387R | 92 |
| 47 | + | ++ | + | E387T | 93 |
| 48 | + | + | + | E40D | 94 |
| 49 | + | + | + | F180R | 95 |
| 50 | ++ | ++ | ++ | F180S | 96 |
| 51 | ++ | ++ | + | F198S | 97 |
| 52 | ++ | + | ++ | F217D | 98 |
| 53 | + | ++ | ++ | F217R | 99 |
| 54 | + | + | + | F352I | 100 |
| 55 | ++ | +++ | ++ | F352V/F365I | 101 |
| 56 | ++ | ++ | ++ | F365I | 102 |
| 57 | ++ | ++ | ++ | F365K | 103 |
| 58 | ++ | ++ | ++ | F365L | 104 |
| 59 | + | + | + | F365R | 105 |
| 60 | + | + | + | F365T | 106 |
| 61 | ++ | ++ | ++ | F365V | 107 |
| 62 | ++ | + | ++ | G303Q/R373V | 108 |
| 63 | + | + | ++ | H155A | 109 |
| 64 | + | + | ++ | H155L | 110 |
| 65 | + | + | + | H155R | 111 |
| 66 | + | + | + | H155T | 112 |
| 67 | ++ | + | ++ | H375E | 113 |
| 68 | + | ++ | + | H84S | 114 |
| 69 | + | + | + | I102L | 115 |
| 70 | + | + | + | I102L/L394V | 116 |
| 71 | ++ | + | ++ | I123T/T369N | 117 |
| 72 | + | + | + | I167V | 118 |
| 73 | + | +++ | ++ | K206A | 10 |
| 74 | + | +++ | ++ | K206M | 119 |
| 75 | + | +++ | ++ | K206Q | 120 |
| 76 | + | +++ | ++ | K206R | 24 |

TABLE 2.2-continued

Relative Activity of GLA Variants After No Challenge
(NC) or Challenge at the Indicated pH[1,2,3]

| Variant # | NC | pH 4.2 | pH 7.1 | Amino Acid Differences Relative to SEQ ID NO: 5 | SEQ ID NO: |
|---|---|---|---|---|---|
| 77 | + | ++ | + | K206T/V359S | 121 |
| 78 | ++ | ++ | ++ | K343D | 122 |
| 79 | ++ | ++ | ++ | K343G | 123 |
| 80 | + | + | + | K362Q | 124 |
| 81 | + | + | + | K362R | 125 |
| 82 | + | + | + | K36D | 126 |
| 83 | + | ++ | + | K36E | 127 |
| 84 | ++ | ++ | ++ | K395* | 128 |
| 85 | + | + | + | K395G | 129 |
| 86 | ++ | ++ | ++ | K395P | 130 |
| 87 | + | ++ | + | K395R | 131 |
| 88 | + | ++ | + | K395S | 132 |
| 89 | ++ | + | + | K395T | 133 |
| 90 | + | + | + | K96I | 134 |
| 91 | + | + | ++ | K96L | 135 |
| 92 | + | + | + | K96R | 136 |
| 93 | ++ | +++ | + | K96R/L397V | 137 |
| 94 | + | + | + | L100F | 138 |
| 95 | + | + | + | L158A | 139 |
| 96 | + | + | + | L158I | 140 |
| 97 | + | + | + | L158M | 141 |
| 98 | + | + | + | L158R | 142 |
| 99 | + | + | + | L23M | 143 |
| 100 | + | + | + | L23T | 144 |
| 101 | +++ | +++ | +++ | L316D | 145 |
| 102 | +++ | +++ | +++ | L316E | 146 |
| 103 | ++ | ++ | ++ | L384F | 147 |
| 104 | ++ | ++ | ++ | L386V | 148 |
| 105 | +++ | ++ | ++ | L394A | 149 |
| 106 | ++ | ++ | +++ | L394R | 150 |
| 107 | +++ | +++ | +++ | L394S | 151 |
| 108 | +++ | +++ | +++ | L394T | 152 |
| 109 | ++ | ++ | +++ | L397* | 153 |
| 110 | +++ | ++ | +++ | L397D | 154 |
| 111 | ++ | ++ | ++ | L397H | 155 |
| 112 | + | ++ | + | L397I | 156 |
| 113 | ++ | + | +++ | L397Q | 157 |
| 114 | ++ | ++ | ++ | L397R | 158 |
| 115 | ++ | ++ | +++ | L397T | 159 |
| 116 | ++ | ++ | ++ | L398E | 160 |
| 117 | ++ | ++ | ++ | L398G | 161 |
| 118 | ++ | ++ | ++ | L398N | 162 |
| 119 | ++ | ++ | ++ | L398Q | 163 |
| 120 | ++ | ++ | ++ | L398R | 164 |
| 121 | + | ++ | ++ | L44R/L384F | 165 |
| 122 | ++ | ++ | ++ | L44T | 166 |
| 123 | − | + | − | M20D/Q302K | 167 |
| 124 | ++ | ++ | + | M253F | 168 |
| 125 | + | + | + | M322I | 169 |
| 126 | +++ | +++ | +++ | M390D | 170 |
| 127 | ++ | ++ | ++ | M390R | 171 |
| 128 | + | + | + | M390T | 172 |
| 129 | + | ++ | ++ | M392G | 173 |
| 130 | + | ++ | + | M392P | 174 |
| 131 | ++ | + | ++ | M392S | 175 |
| 132 | + | + | + | M39Y | 176 |
| 133 | + | + | + | N388R | 177 |
| 134 | + | + | + | N91Q | 178 |
| 135 | ++ | +++ | ++ | Q190S/T369D | 179 |
| 136 | + | + | + | Q249A | 180 |
| 137 | + | + | + | Q302A | 181 |
| 138 | ++ | ++ | ++ | Q385H | 182 |
| 139 | + | + | + | Q385I | 183 |
| 140 | ++ | ++ | ++ | Q385L | 184 |
| 141 | + | + | + | Q391G | 185 |
| 142 | + | + | + | Q80A | 186 |
| 143 | + | + | + | Q80H | 187 |
| 144 | + | ++ | + | Q80V | 188 |
| 145 | + | + | + | Q88A | 189 |
| 146 | + | + | + | Q88F | 190 |
| 147 | ++ | ++ | ++ | Q88H | 191 |
| 148 | + | ++ | + | Q88R | 192 |
| 149 | ++ | + | ++ | Q88S | 193 |
| 150 | + | + | + | R162H | 194 |

TABLE 2.2-continued

Relative Activity of GLA Variants After No Challenge
(NC) or Challenge at the Indicated pH[1,2,3]

| Variant # | NC | pH 4.2 | pH 7.1 | Amino Acid Differences Relative to SEQ ID NO: 5 | SEQ ID NO: |
|---|---|---|---|---|---|
| 151 | + | + | + | R162S | 195 |
| 152 | ++ | ++ | ++ | R221K/A350G | 196 |
| 153 | + | + | ++ | R221T | 197 |
| 154 | ++ | + | ++ | R301I/K362T | 198 |
| 155 | + | + | + | R301L | 199 |
| 156 | ++ | + | ++ | R371S | 200 |
| 157 | ++ | + | ++ | R371V | 201 |
| 158 | ++ | + | ++ | R87K | 202 |
| 159 | + | + | + | R87P/L398R | 203 |
| 160 | + | ++ | + | S166A | 204 |
| 161 | + | + | + | S166H | 205 |
| 162 | + | + | + | S166K | 206 |
| 163 | + | + | + | S31D | 207 |
| 164 | + | − | − | S34D/M392P | 208 |
| 165 | + | − | − | S34G | 209 |
| 166 | ++ | + | + | S34H/M390R | 210 |
| 167 | + | + | + | S34R | 211 |
| 168 | ++ | ++ | ++ | S374M | 212 |
| 169 | ++ | ++ | ++ | S374T | 213 |
| 170 | ++ | ++ | ++ | S393E | 214 |
| 171 | ++ | ++ | ++ | S393G | 215 |
| 172 | + | + | + | S393H | 216 |
| 173 | ++ | ++ | ++ | S393P | 217 |
| 174 | + | + | + | S47I | 218 |
| 175 | + | ++ | + | S47R | 219 |
| 176 | + | + | + | S47T | 220 |
| 177 | + | ++ | + | S95D | 221 |
| 178 | ++ | +++ | ++ | S95E | 222 |
| 179 | + | + | + | S95Q | 223 |
| 180 | ++ | ++ | +++ | T369D | 224 |
| 181 | + | + | + | T369S | 225 |
| 182 | ++ | + | + | T389S | 226 |
| 183 | + | + | + | V133I | 227 |
| 184 | ++ | + | + | V168A | 228 |
| 185 | + | ++ | + | V168L | 229 |
| 186 | ++ | ++ | +++ | V345N | 230 |
| 187 | + | + | + | V345Y | 231 |
| 188 | + | + | + | V359E | 232 |
| 189 | + | + | + | V93I | 233 |
| 190 | ++ | + | + | W178H | 234 |
| 191 | + | ++ | + | W178S | 235 |

[1]Relative activity was calculated as activity of the variant/activity of WT GLA (SEQ ID NO: 5 (encoded by SEQ ID NO: 3).
[2]Variant # 73 (Rd2BB) has the polynucleotide sequence of SEQ ID NO: 8 and polypeptide sequence of SEQ ID NO: 10.
[3]− = <0.5 relative activity to WT GLA (SEQ ID NO: 5); + = 0.5 to 1.5 relative activity over WT GLA (SEQ ID NO: 5); ++ = >1.5 to 2.5 relative activity over WT GLA (SEQ ID NO: 5); and +++ = >2.5 relative activity over WT GLA (SEQ ID NO: 5).

TABLE 2.3

Relative Activity of GLA Variants After No Challenge
(NC) or Challenge at the Indicated pH

| Variant # | NC | pH 4.2 | pH 7.6 | Amino Acid Differences Relative to SEQ ID NO: 10 | SEQ ID NO: |
|---|---|---|---|---|---|
| 192 | + | + | + | A206E | 236 |
| 193 | + | + | + | A206G | 237 |
| 194 | ++ | ++ | ++ | A206R | 238 |
| 195 | + | + | + | A206S | 239 |
| 196 | + | + | + | A350G | 240 |
| 197 | ++ | ++ | ++ | A350G/K362Q/T369A | 241 |
| 198 | ++ | ++ | +++ | A350G/T369D | 242 |
| 199 | ++ | ++ | ++ | A350G/T369S | 243 |
| 200 | + | + | + | C143A | 244 |
| 201 | + | + | + | C143T | 245 |
| 202 | + | + | + | C59A | 246 |
| 203 | ++ | + | +++ | E367A/T369D | 247 |
| 204 | + | + | + | E367D | 248 |
| 205 | ++ | + | ++ | E367D/T369D | 21 |
| 206 | +++ | +++ | +++ | E367N | 18 |
| 207 | ++ | +++ | +++ | E367N/R373K | 249 |
| 208 | ++ | +++ | +++ | E367N/R373K/I376V | 250 |
| 209 | + | + | + | E367P/T369D | 251 |
| 210 | ++ | ++ | ++ | F365L/E367N | 252 |
| 211 | ++ | ++ | ++ | F365L/E367N/I376V | 253 |
| 212 | ++ | ++ | ++ | F365L/E367N/R373K/I376V | 254 |
| 213 | − | − | − | H15Q/ | 255 |
| 214 | +++ | +++ | +++ | K343D/F365L/E367N | 256 |
| 215 | + | + | + | K343G | 257 |
| 216 | ++ | +++ | +++ | K343G/F365L/E367N/R373K | 258 |
| 217 | ++ | ++ | ++ | L316D | 259 |
| 218 | +++ | +++ | +++ | M322I/E367N/R373K | 13 |
| 219 | + | + | + | M322I/R373K | 260 |
| 220 | + | + | ++ | M322V/R373K/I376V | 261 |
| 221 | + | + | + | M390I | 262 |
| 222 | ++ | + | + | P228Q/T369D | 263 |
| 223 | + | ++ | ++ | Q302K/A337P/A350G/K362Q | 264 |

TABLE 2.3-continued

Relative Activity of GLA Variants After No Challenge (NC) or Challenge at the Indicated pH

| Variant # | NC | pH 4.2 | pH 7.6 | Amino Acid Differences Relative to SEQ ID NO: 10 | SEQ ID NO: |
|---|---|---|---|---|---|
| 224 | ++ | +++ | +++ | Q302K/M322V/E367N | 265 |
| 225 | + | + | + | R165S | 266 |
| 226 | + | + | ++ | R221T/F365L | 267 |
| 227 | − | − | − | R325H | 268 |
| 228 | + | + | + | R373K | 269 |
| 229 | + | − | + | R373K/I376V | 270 |
| 230 | + | − | + | S374R | 271 |
| 231 | ++ | ++ | ++ | T369D | 272 |
| 232 | ++ | ++ | ++ | T369S | 273 |

1. Relative activity was calculated as activity of the variant/activity of Rd2BB (SEQ ID NO: 10)
2. Variant # 218 (Rd3BB) has the polynucleotide sequence of SEQ ID NO: 11 and polypeptide sequence of SEQ ID NO: 13.
3. − = <0.5 relative activity to Rd2BB (SEQ ID NO: 10); + = 0.5 to 1.5 relative activity over Rd2BB (SEQ ID NO: 10); ++ = >1.5 to 2.5 relative activity over Rd2BB (SEQ ID NO: 10); and +++ = >2.5 relative activity over Rd2BB (SEQ ID NO: 10).

TABLE 2.4

Relative Activity of GLA Variants After No Challenge (NC) or Challenge at the Indicated pH or Condition[1,2]

| Variant # | NC | pH 4.2 | pH 7.6 | Serum | Amino Acid Differences Relative to SEQ ID NO: 5 (WT GLA) | SEQ ID NO: |
|---|---|---|---|---|---|---|
| 233 | +++ | +++ | +++ | +++ | K206A/F217R/N247D/L316D/A350G/E367D/T369D | 274 |
| 234 | +++ | +++ | +++ | +++ | K206A/F217R/N247D/Q302K/A350G/E367D/T369D | 275 |
| 235 | +++ | +++ | +++ | +++ | K206A/F217R/N247D/Q302K/L316D/A337P/A350G/E367D/T369D | 276 |
| 236 | +++ | ++ | +++ | ++ | K206A/F217R/Q302K/E367D/T369D | 277 |
| 237 | +++ | +++ | +++ | +++ | K206A/F217R/Q302K/L316D/A337P/A350G/E367D/T369D | 278 |
| 238 | ++ | +++ | +++ | ++ | K206A/I208V/M322V/K343G/F365L/R373K/I376V | 279 |
| 239 | +++ | +++ | +++ | ++ | K206A/I208V/R221K/N247D/M322I/K343D/F365L/R373K/I376V | 280 |
| 240 | − | + | + | + | K206A/L269I/P349L/R373K | 281 |
| 241 | ++ | +++ | +++ | ++ | K206A/N247D/M322V/K343D/R373K/I376V | 282 |
| 242 | +++ | +++ | +++ | +++ | K206A/N247D/M322V/K343G/F365L/R373K | 283 |
| 243 | +++ | +++ | +++ | +++ | K206A/N247D/Q302K/A337P/K343G/A350G | 284 |
| 244 | +++ | +++ | +++ | +++ | K206A/N247D/Q302K/L316D/A350G | 285 |
| 245 | ++ | +++ | +++ | ++ | K206A/N247D/Q302K/M322V/F365L/R373K/I376V | 286 |
| 246 | +++ | +++ | +++ | +++ | K206A/Q302K/L316D/A337P | 287 |
| 247 | +++ | +++ | +++ | +++ | K206A/R221K/N247D/M322V/K343D/R373K | 288 |
| 248 | + | + | + | + | K206A/R221T/M322V/K343G/R373K | 289 |
| 249 | ++ | ++ | +++ | ++ | K206A/R221T/M322V/R373K | 290 |
| 250 | + | + | + | + | K96I/K206A/F217R | 291 |
| 251 | ++ | + | ++ | + | K96I/K206A/F217R/N247D | 292 |
| 252 | +++ | +++ | +++ | +++ | K96I/K206A/F217R/N247D/A350G/E367D/T369D | 293 |
| 253 | +++ | +++ | +++ | +++ | K96I/K206A/F217R/N247D/Q302K/L316D/A337P/E367D/T369D | 294 |
| 254 | + | + | + | + | L100F/K206A | 295 |
| 255 | +++ | +++ | +++ | ++ | L100F/K206A/I208V/R221K/N247D/Q302K/M322I/K343D/F365L/I376V | 296 |
| 256 | ++ | +++ | +++ | +++ | L100F/K206A/I208V/R221K/N247D/Q302K/M322V/K343D/F365L/I376V | 297 |
| 257 | ++ | ++ | ++ | ++ | L100F/K206A/I208V/R221T/N247D/K343D/F365L/I376V | 298 |
| 258 | +++ | ++ | +++ | ++ | L100F/K206A/I208V/R221T/Q302K/M322I/K343D/I376V | 299 |
| 259 | + | + | + | + | L100F/K206A/M322V/F365L/R373K/I376V | 300 |
| 260 | + | + | + | + | L100F/K206A/N247D/F365L/R373K/I376V | 301 |
| 261 | ++ | ++ | ++ | + | L100F/K206A/N247D/M322V/K343D/I376V | 302 |
| 262 | ++ | +++ | +++ | +++ | L100F/K206A/R221K/N247D/Q302K/M322V/F365L/R373K/I376V | 303 |
| 263 | + | ++ | ++ | +++ | L100F/K206A/R221K/N247D/Q302K/M322V/I376V | 304 |
| 264 | ++ | ++ | +++ | ++ | L100F/K206A/R221K/N247D/Q302K/M322V/K343D/R373K/I376V | 305 |
| 265 | + | + | + | + | L100F/K206A/R221K/R373K/I376V | 306 |
| 266 | ++ | ++ | +++ | ++ | L100F/K206A/R221T/M322I/K343E/F365L/R373K | 307 |
| 267 | +++ | +++ | +++ | +++ | L100F/K206A/R221T/N247D/Q302K/K343D/F365L/R373K | 308 |
| 268 | + | + | + | + | L100F/K206A/R373K/I376V | 309 |
| 269 | − | + | + | + | L37I/K206A/R221K/N247D/M322I/R373K | 310 |
| 270 | + | + | + | + | L44R/C143Y/K206A/A337P/A350G | 311 |
| 271 | − | + | + | + | L44R/E187G/K206A/A337P/A350G | 312 |
| 272 | + | + | + | + | L44R/K206A | 313 |
| 273 | + | + | + | + | L44R/K206A/E367D/T369D | 314 |
| 274 | + | + | + | + | L44R/K206A/F217R/A350G | 315 |
| 275 | ++ | ++ | ++ | ++ | L44R/K206A/F217R/N247D/A337P | 316 |

TABLE 2.4-continued

Relative Activity of GLA Variants After No Challenge (NC) or Challenge at the Indicated pH or Condition[1,2]

| Variant # | NC | pH 4.2 | pH 7.6 | Serum | Amino Acid Differences Relative to SEQ ID NO: 5 (WT GLA) | SEQ ID NO: |
|---|---|---|---|---|---|---|
| 276 | +++ | +++ | +++ | +++ | L44R/K206A/F217R/N247D/L316D/A337P/A350G/E367D/T369D | 317 |
| 277 | +++ | +++ | +++ | +++ | L44R/K206A/F217R/N247D/L316D/A337P/E367D/T369D | 318 |
| 278 | +++ | +++ | +++ | +++ | L44R/K206A/F217R/N247D/L316D/A350G/E367D/T369D | 319 |
| 279 | ++ | +++ | +++ | +++ | L44R/K206A/F217R/N247D/Q302K/A350G | 320 |
| 280 | + | + | + | + | L44R/K206A/F217R/Q302K/E367D/T369D | 321 |
| 281 | + | + | + | + | L44R/K206A/I208V/R221K/M322V/K343D/F365L/R373K | 322 |
| 282 | + | + | + | + | L44R/K206A/N247D/A337P | 323 |
| 283 | +++ | +++ | +++ | +++ | L44R/K206A/N247D/Q302K/A337P/A350G/E367D/T369D | 324 |
| 284 | +++ | +++ | +++ | +++ | L44R/K206A/R221T/N247D/M322I/K343D/F365L/I376V | 325 |
| 285 | + | + | ++ | + | L44R/K96I/K206A | 326 |
| 286 | + | + | ++ | + | L44R/K96I/K206A/F217R/N247D | 327 |
| 287 | +++ | +++ | +++ | ++ | L44R/K96I/K206A/F217R/N247D/Q302K/A337P/A350G | 328 |
| 288 | +++ | +++ | +++ | +++ | L44R/K96I/K206A/F217R/N247D/Q302K/A337P/K343D/A350G/E367D/T369D | 329 |
| 289 | + | ++ | ++ | ++ | L44R/K96I/K206A/F217R/Q302K/A350G | 330 |
| 290 | +++ | +++ | +++ | +++ | L44R/K96I/K206A/N247D/L316D/A337P/A350G/E367D/T369D | 331 |
| 291 | + | + | + | + | L44R/L100F/K206A/F365L | 332 |
| 292 | +++ | ++ | +++ | ++ | L44R/L100F/K206A/I208V/Q219H/N247D/Q302K/M322V/K343D/R373K/I376V | 333 |
| 293 | ++ | + | ++ | + | L44R/L100F/K206A/I208V/R221K/N247D/Q302K/M322V/F365L/I376V | 334 |
| 294 | ++ | ++ | +++ | + | L44R/L100F/K206A/I208V/R221T/N247D/M322V/I376V | 335 |
| 295 | +++ | +++ | +++ | +++ | L44R/L100F/K206A/I208V/R221T/N247D/Q302K/M322I/K343D/F365L/R373K/I376V | 336 |

[1] Relative activity was calculated as activity of the variant/activity of Rd2BB (SEQ ID NO: 10) (encoded by SEQ ID NO: 8).
[2] − = <0.5 relative activity to Rd2BB (SEQ ID NO: 10); + = 0.5 to 1.5 relative activity over Rd2BB (SEQ ID NO: 10); ++ = >1.5 to 2.5 relative activity over Rd2BB (SEQ ID NO: 10); and +++ = >2.5 relative activity over Rd2BB (SEQ ID NO: 10).

TABLE 2.5

Relative Activity of GLA Variants After No Challenge (NC) or Challenge at the Indicated pH or Condition [1,2,3]

| Variant # | NC | pH 4.0 | pH 8.2 | Serum | Amino Acid Differences Relative to SEQ ID NO: 5 (WT GLA) | SEQ ID NO: |
|---|---|---|---|---|---|---|
| 296 | + | − | − | + | A66T/K206A/F217R/L316D/M322I/A337P/K343G/A350G/E367N/R373K | 337 |
| 297 | − | − | − | − | K206A/F217R/G230V/N247D/Q302K/M322I/E367N/T369S/R373K | 338 |
| 298 | ++ | +++ | +++ | +++ | K206A/F217R/N247D/L316D/M322I/A337P/A350G/K362Q/E367N/R373K | 339 |
| 299 | + | − | − | − | K206A/F217R/N247D/Q249H/Q302K/M322I/K343G/A350G/E367T/R373K/L397F | 340 |
| 300 | + | ++ | ++ | ++ | K206A/I208V/R221T/N247D/M322V/K343G/E367N/R373K | 341 |
| 301 | + | + | + | − | K206A/M322I/E367N/R373K | 342 |
| 302 | + | + | + | + | K206A/M322V/K343G/E367N/R373K | 343 |
| 303 | ++ | ++ | ++ | + | K206A/N247D/M322I/A337E/K343D/F365L/E367N/R373K/I376V | 344 |
| 304 | ++ | ++ | ++ | ++ | K206A/Q302K/L316D/M322I/A337P/A350G/K362Q/E367N/T369S/R373K | 345 |
| 305 | + | + | + | ++ | K206A/Q302K/L316D/M322I/A337P/K343D/E367N/T369S/R373K | 346 |
| 306 | + | ++ | ++ | ++ | K206A/R221K/N247D/Q302K/M322I/E367N/R373K | 347 |
| 307 | + | + | + | + | K206A/R221K/Q302K/M322I/K343G/E367N/R373K/I376V | 348 |
| 308 | − | − | − | + | K96I/K206A/F217R/M322I/E367N/T369S/R373K | 349 |
| 309 | + | ++ | +++ | ++ | K96I/K206A/F217R/N247D/Q302K/M322I/A337P/K343G/A350G/E367N/R373K | 350 |
| 310 | − | + | + | + | K96I/K206A/N247D/M322I/A350G/E367N/T369S/R373K | 351 |

TABLE 2.5-continued

Relative Activity of GLA Variants After No Challenge (NC)
or Challenge at the Indicated pH or Condition [1, 2, 3]

| Variant # | NC | pH 4.0 | pH 8.2 | Serum | Amino Acid Differences Relative to SEQ ID NO: 5 (WT GLA) | SEQ ID NO: |
|---|---|---|---|---|---|---|
| 311 | + | + | ++ | + | K96I/K206A/N247D/Q302K/L316D/M322I/A337P/A350G/E367N/T369S/R373K | 352 |
| 312 | ++ | +++ | +++ | +++ | K96I/K206A/N247D/Q302K/L316D/M322I/A337P/A350G/K362Q/E367N/T369S/R373K | 353 |
| 313 | + | + | − | + | L100F/A125S/K206A/I208V/R221K/Q302K/M322I/K343G/E367N/R373K | 354 |
| 314 | + | ++ | ++ | + | L100F/K206A/I208V/N247D/Q302K/M322V/K343D/E367N/R373K/I376V | 355 |
| 315 | + | + | + | + | L100F/K206A/I208V/Q302K/M322V/F365L/E367N/R373K/I376V | 356 |
| 316 | + | + | + | + | L100F/K206A/I208V/R221K/M322V/K343D/E367N/R373K | 357 |
| 317 | + | + | − | − | L100F/K206A/I208V/R221K/M322V/K343D/F365L/E367N/R373K | 358 |
| 318 | + | + | ++ | + | L100F/K206A/I208V/R221T/M322V/E367N/R373K/I376V | 359 |
| 319 | + | + | + | + | L100F/K206A/M322I/E367N/R373K/I376V | 360 |
| 320 | + | + | + | + | L100F/K206A/N247D/Q302K/M322I/E367N/R373K | 361 |
| 321 | ++ | ++ | +++ | + | L100F/K206A/R221K/N247D/M322I/K343G/E367N/R373K | 362 |
| 322 | + | + | ++ | + | L100F/K206A/R221T/Q302K/M322I/K343D/E367N/R373K | 363 |
| 323 | − | − | − | + | L100F/L160I/K206A/R221K/M322V/E367N/R373K | 364 |
| 324 | − | − | − | − | L23S/K206A/M322I/E367N/R373K | 365 |
| 325 | ++ | +++ | +++ | +++ | L44R/K206A/F217R/N247D/L316D/M322I/A337P/K343G/K362Q/E367N/R373K | 366 |
| 326 | ++ | +++ | +++ | +++ | L44R/K206A/F217R/N247D/Q302K/L316D/M322I/A337P/K362Q/E367N/R373K | 367 |
| 327 | ++ | +++ | +++ | +++ | L44R/K206A/F217R/N247D/Q302K/L316D/M322I/K343D/A350G/K362Q/E367N/R373K | 368 |
| 328 | + | + | + | + | L44R/K206A/F217R/Q302K/M322I/A337P/A350G/E367N/T369S/R373K | 369 |
| 329 | + | ++ | ++ | ++ | L44R/K206A/I208V/N247D/Q302K/M322I/K343D/E367N/R373K | 370 |
| 330 | ++ | ++ | + | + | L44R/K206A/I208V/R221K/M322I/K343D/E367N/R373K | 371 |
| 331 | + | ++ | ++ | + | L44R/K206A/I208V/R221K/N247D/Q302K/M322I/K343D/E367N/R373K/I376V | 372 |
| 332 | + | + | + | + | L44R/K206A/I208V/R221T/Q302K/M322I/K343G/F365L/E367N/R373K/I376V | 373 |
| 333 | ++ | ++ | ++ | + | L44R/K206A/L316D/M322I/A337P/A350G/E367N/T369S/R373K | 374 |
| 334 | + | ++ | +++ | ++ | L44R/K206A/N247D/L316D/M322I/A350G/K362Q/E367N/T369S/R373K | 375 |
| 335 | ++ | +++ | +++ | +++ | L44R/K206A/N247D/Q302K/L316D/M322I/A337P/K343G/A350G/K362Q/E367N/T369S/R373K | 376 |
| 336 | + | + | + | − | L44R/K206A/N247D/Q302K/M322I/A350G/E367N/T369S/R373K | 377 |
| 337 | + | ++ | ++ | ++ | L44R/K206A/N247D/Q302K/M322I/K343D/E367N/R373K | 378 |
| 338 | ++ | +++ | +++ | +++ | L44R/K96I/K206A/F217R/N247D/L316D/M322I/A337P/A350G/K362Q/E367N/R373K | 379 |
| 339 | + | + | ++ | + | L44R/K96I/K206A/F217R/N247D/M322I/A350G/K362Q/E367N/R373K | 380 |
| 340 | + | + | + | + | L44R/K96I/K206A/F217R/N247D/M322I/A350G/K362Q/E367N/T369S/R373K | 381 |
| 341 | − | + | + | + | L44R/K96I/K206A/F217R/N247D/M322I/E367N/T369S/R373K | 382 |
| 342 | ++ | +++ | +++ | +++ | L44R/K96I/K206A/F217R/N247D/Q302K/L316D/M322I/A337P/E367N/R373K | 383 |
| 343 | + | + | + | + | L44R/K96I/K206A/F217R/N247D/Q302K/M322I/E367N/T369S/R373K | 384 |
| 344 | + | + | + | ++ | L44R/K96I/K206A/F217R/N247D/Q302K/M322I/K362Q/E367N/R373K | 385 |
| 345 | + | ++ | +++ | + | L44R/K96I/K206A/F217R/Q219P/N247D/M253K/S266F/D284E/Q290P/L293F/Q302K/V308G/S314F/M322I/A337P/K343E/E367N/R373K | 386 |
| 346 | + | + | ++ | + | L44R/K96I/K206A/F217R/Q302K/M322I/A350G/K362Q/E367N/T369S/R373K | 387 |
| 347 | − | − | − | − | L44R/K96I/K206A/M322I/A337P/E367N/T369S/R373K | 388 |
| 348 | + | + | + | + | L44R/L100F/K206A/I208V/R221K/M322I/K343G/F365L/E367N/R373K | 389 |

TABLE 2.5-continued

Relative Activity of GLA Variants After No Challenge (NC) or Challenge at the Indicated pH or Condition [1, 2, 3]

| Variant # | NC | pH 4.0 | pH 8.2 | Serum | Amino Acid Differences Relative to SEQ ID NO: 5 (WT GLA) | SEQ ID NO: |
|---|---|---|---|---|---|---|
| 349 | + | + | ++ | + | L44R/L100F/K206A/I208V/R221T/N247D/M322I/F365L/E367N/R373K | 390 |
| 350 | + | ++ | +++ | + | L44R/L100F/K206A/I208V/R221T/N247D/M322V/E367N/R373K/I376V | 391 |
| 351 | + | + | ++ | + | L44R/L100F/K206A/I208V/R221T/Q302K/M322I/E367N/R373K/I376V | 392 |
| 352 | + | + | + | + | L44R/L100F/K206A/Q302K/M322I/E367N/R373K/I376V | 393 |
| 353 | − | − | − | + | L44R/L100F/K206A/R221K/M322I/F365L/E367N/R373K/I376V | 394 |
| 354 | − | + | + | + | L44R/L100F/K206A/R221T/M322I/F365L/E367N/R373K | 395 |
| 355 | + | ++ | ++ | + | L44R/L100F/K206A/R221T/N247D/M322I/K343D/E367N/R373K/I376V | 396 |
| 356 | + | + | ++ | + | L44R/L100F/K206A/R221T/N247D/Q302K/M322I/E367N/R373K | 397 |
| 357 | + | ++ | +++ | + | L44R/L100F/K206A/R221T/N247D/Q302K/M322V/E367N/R373K/I376V | 398 |
| 358 | + | + | ++ | + | L44R/L100F/K206A/R221T/Q302K/M322I/E367N/R373K | 399 |
| 359 | + | + | +++ | + | L44R/L100F/Q181L/K206A/R221T/N247D/Q302K/M322V/E367N/R373K/I376V | 400 |

[1] Relative activity was calculated as activity of the variant/activity of Rd3BB (SEQ ID NO: 13 (encoded by SEQ ID NO: 11).
[2] Variant # 326 (Rd4BB) has the polynucleotide sequence of SEQ ID NO: 14 and polypeptide sequence of SEQ ID NO: 15.
[3] − = <0.5 relative activity to Rd3BB (SEQ ID NO: 13); + = 0.5 to 1.5 relative activity over Rd3BB (SEQ ID NO: 13); ++ = >1.5 to 2.5 relative activity over Rd3BB (SEQ ID NO: 13); and +++ = >2.5 relative activity over Rd3BB (SEQ ID NO: 13).

TABLE 2.6

Relative Activity of GLA Variants After No Challenge (NC) or Challenge at the Indicated pH or Condition [1, 2, 3, 4]

| Variant # | NC | pH 3.7 | pH 9.65 | Amino acid differences relative to SEQ ID NO: 5 (WT GLA) | SEQ ID NO: |
|---|---|---|---|---|---|
| 360 | + | + | + | L44E/K206A/F217R/N247D/Q302K/L316D/M322I/A337P/K362Q/E367N/R373K | 401 |
| 361 | + | + | + | L44R/S47R/K206A/F217R/N247D/Q302K/L316D/M322I/A337P/K362Q/E367N/R373K | 402 |
| 362 | + | + | + | L44C/K206A/F217R/N247D/Q302K/L316D/M322I/A337P/K362Q/E367N/R373K | 403 |
| 363 | + | + | + | L44R/S47D/K206A/F217R/N247D/Q302K/L316D/M322I/A337P/K362Q/E367N/R373K | 404 |
| 364 | + | + | − | M39H/L44R/K206A/F217R/N247D/Q302K/L316D/M322I/A337P/K362Q/E367N/R373K | 405 |
| 365 | + | + | + | L44R/S47N/K206A/F217R/N247D/Q302K/L316D/M322I/A337P/K362Q/E367N/R373K | 406 |
| 366 | + | + | + | L44R/S47V/K206A/F217R/N247D/Q302K/L316D/M322I/A337P/K362Q/E367N/R373K | 407 |
| 367 | + | + | − | M39R/L44R/K206A/F217R/N247D/Q302K/L316D/M322I/A337P/K362Q/E367N/R373K | 408 |
| 368 | + | + | + | L44A/K206A/F217R/N247D/Q302K/L316D/M322I/A337P/K362Q/E367N/R373K | 409 |
| 369 | + | + | − | L44S/K206A/F217R/N247D/Q302K/L316D/M322I/A337P/K362Q/E367N/R373K | 410 |
| 370 | + | ++ | + | L44Q/K206A/F217R/N247D/Q302K/L316D/M322I/A337P/K362Q/E367N/R373K | 411 |
| 371 | + | − | + | L44W/K206A/F217R/N247D/Q302K/L316D/M322I/A337P/K362Q/E367N/R373K | 412 |
| 372 | + | − | + | L44V/K206A/F217R/N247D/Q302K/L316D/M322I/A337P/K362Q/E367N/R373K | 413 |
| 373 | − | − | − | M41R/L44R/K206A/F217R/N247D/Q302K/L316D/M322I/A337P/K362Q/E367N/R373K | 414 |
| 374 | + | + | + | L44M/K206A/F217R/N247D/Q302K/L316D/M322I/A337P/K362Q/E367N/R373K | 415 |
| 375 | + | + | + | L44R/S47I/K206A/F217R/N247D/Q302K/L316D/M322I/A337P/K362Q/E367N/R373K | 416 |
| 376 | − | − | + | M41P/L44R/K206A/F217R/N247D/Q302K/L316D/M322I/A337P/K362Q/E367N/R373K | 417 |
| 377 | + | ++ | − | M39T/L44R/K206A/F217R/N247D/Q302K/L316D/M322I/A337P/K362Q/E367N/R373K | 418 |

TABLE 2.6-continued

Relative Activity of GLA Variants After No Challenge (NC) or Challenge at the Indicated pH or Condition [1,2,3,4]

| Variant # | NC | pH 3.7 | pH 9.65 | Amino acid differences relative to SEQ ID NO: 5 (WT GLA) | SEQ ID NO: |
|---|---|---|---|---|---|
| 378 | + | − | + | L44T/K206A/F217R/N247D/Q302K/L316D/M322I/A337P/K362Q/E367N/R373K | 419 |
| 379 | + | ++ | + | L44R/S47T/K206A/F217R/N247D/Q302K/L316D/M322I/A337P/K362Q/E367N/R373K | 420 |
| 380 | + | + | − | L44R/Y92K/K206A/F217R/N247D/Q302K/L316D/M322I/A337P/K362Q/E367N/R373K | 421 |
| 381 | + | + | − | L44R/Y92S/K206A/F217R/N247D/Q302K/L316D/M322I/A337P/K362Q/E367N/R373K | 422 |
| 382 | − | − | − | L44R/H94N/K206A/F217R/N247D/Q302K/L316D/M322I/A337P/K362Q/E367N/R373K | 423 |
| 383 | + | − | − | L44R/Y92C/K206A/F217R/N247D/Q302K/L316D/M322I/A337P/K362Q/E367N/R373K | 424 |
| 384 | + | + | − | L44R/Y92V/K206A/F217R/N247D/Q302K/L316D/M322I/A337P/K362Q/E367N/R373K | 425 |
| 385 | + | + | − | L44R/Y92A/K206A/F217R/N247D/Q302K/L316D/M322I/A337P/K362Q/E367N/R373K | 426 |
| 386 | − | + | − | L44R/H94R/K206A/F217R/N247D/Q302K/L316D/M322I/A337P/K362Q/E367N/R373K | 427 |
| 387 | + | + | − | L44R/V93T/K206A/F217R/N247D/Q302K/L316D/M322I/A337P/K362Q/E367N/R373K | 428 |
| 388 | + | − | + | L44R/V93L/K206A/F217R/N247D/Q302K/L316D/M322I/A337P/K362Q/E367N/R373K | 429 |
| 389 | + | + | − | L44R/V93S/K206A/F217R/N247D/Q302K/L316D/M322I/A337P/K362Q/E367N/R373K | 430 |
| 390 | + | + | − | L44R/Y92Q/K206A/F217R/N247D/Q302K/L316D/M322I/A337P/K362Q/E367N/R373K | 431 |
| 391 | + | + | − | L44R/Y92W/K206A/F217R/N247D/Q302K/L316D/M322I/A337P/K362Q/E367N/R373K/L397S | 432 |
| 392 | + | + | − | L44R/Y92T/K206A/F217R/N247D/Q302K/L316D/M322I/A337P/K362Q/E367N/R373K | 433 |
| 393 | + | − | − | L44R/Y92G/K206A/F217R/N247D/Q302K/L316D/M322I/A337P/K362Q/E367N/R373K | 434 |
| 394 | + | + | − | L44R/Y92R/K206A/F217R/N247D/Q302K/L316D/M322I/A337P/K362Q/E367N/R373K | 435 |
| 395 | + | + | + | L44R/Y92H/K206A/F217R/N247D/Q302K/L316D/M322I/A337P/K362Q/E367N/R373K | 40 |
| 396 | + | + | + | L44R/L158M/K206A/F217R/N247D/Q302K/L316D/M322I/A337P/K362Q/E367N/R373K | 437 |
| 397 | + | + | + | L44R/L158R/K206A/F217R/N247D/Q302K/L316D/M322I/A337P/K362Q/E367N/R373K | 438 |
| 398 | + | ++ | − | L44R/A159S/K206A/F217R/N247D/Q302K/L316D/M322I/A337P/K362Q/E367N/R373K | 439 |
| 399 | + | + | + | L44R/R165K/K206A/F217R/N247D/Q302K/L316D/M322I/A337P/K362Q/E367N/R373K | 440 |
| 400 | + | + | − | L44R/L158C/K206A/F217R/N247D/Q302K/L316D/M322I/A337P/K362Q/E367N/R373K | 441 |
| 401 | + | + | − | L44R/T163S/K206A/F217R/N247D/Q302K/L316D/M322I/A337P/K362Q/E367N/R373K | 442 |
| 402 | + | ++ | + | L44R/S166P/K206A/F217R/N247D/Q302K/L316D/M322I/A337P/K362Q/E367N/R373K | 42 |
| 403 | + | + | + | L44R/S166G/K206A/F217R/N247D/Q302K/L316D/M322I/A337P/K362Q/E367N/R373K | 444 |
| 404 | + | + | − | L44R/S166F/K206A/F217R/N247D/Q302K/L316D/M322I/A337P/K362Q/E367N/R373K | 445 |
| 405 | + | ++ | + | L44R/L158E/K206A/F217R/N247D/Q302K/L316D/M322I/A337P/K362Q/E367N/R373K | 446 |
| 406 | + | + | + | L44R/R162K/K206A/F217R/N247D/Q302K/L316D/M322I/A337P/K362Q/E367N/R373K | 447 |
| 407 | + | + | − | L44R/L158H/K206A/F217R/N247D/Q302K/L316D/M322I/A337P/K362Q/E367N/R373K | 448 |
| 408 | + | + | + | L44R/S166R/K206A/F217R/N247D/Q302K/L316D/M322I/A337P/K362Q/E367N/R373K | 449 |
| 409 | + | + | − | L44R/R165H/K206A/F217R/N247D/Q302K/L316D/M322I/A337P/K362Q/E367N/R373K | 450 |
| 410 | + | + | − | L44R/R162H/K206A/F217R/N247D/Q302K/L316D/M322I/A337P/K362Q/E367N/R373K | 451 |
| 411 | + | + | + | L44R/S166A/K206A/F217R/N247D/Q302K/L316D/M322I/A337P/K362Q/E367N/R373K | 452 |
| 412 | + | ++ | + | L44R/S166H/K206A/F217R/N247D/Q302K/L316D/M322I/A337P/K362Q/E367N/R373K | 453 |
| 413 | − | − | − | L44R/T163*/K206A/F217R/N247D/Q302K/L316D/M322I/A337P/K362Q/E367N/R373K | 454 |
| 414 | + | + | + | L44R/L158Q/K206A/F217R/N247D/Q302K/L316D/M322I/A337P/K362Q/E367N/R373K | 455 |

TABLE 2.6-continued

Relative Activity of GLA Variants After No Challenge (NC) or Challenge at the Indicated pH or Condition [1, 2, 3, 4]

| Variant # | NC | pH 3.7 | pH 9.65 | Amino acid differences relative to SEQ ID NO: 5 (WT GLA) | SEQ ID NO: |
|---|---|---|---|---|---|
| 415 | + | + | + | L44R/S166D/K206A/F217R/N247D/Q302K/L316D/ M322I/A337P/K362Q/E367N/R373K | 456 |
| 416 | + | + | − | L44R/R162G/K206A/F217R/N247D/Q302K/L316D/ M322I/A337P/K362Q/E367N/R373K | 457 |
| 417 | + | + | − | L44R/R162S/K206A/F217R/N247D/Q302K/L316D/ M322I/A337P/K362Q/E367N/R373K | 458 |
| 418 | + | + | − | L44R/N161E/K206A/F217R/N247D/Q302K/L316D/ M322I/A337P/K362Q/E367N/R373K | 459 |
| 419 | + | + | + | L44R/S166E/K206A/F217R/N247D/Q302K/L316D/ M322I/A337P/K362Q/E367N/R373K | 460 |
| 420 | + | ++ | − | L44R/S166T/K206A/F217R/N247D/Q302K/L316D/ M322I/A337P/K362Q/E367N/R373K | 461 |
| 421 | + | + | − | L44R/R162Q/K206A/F217R/N247D/Q302K/L316D/ M322I/A337P/K362Q/E367N/R373K | 462 |
| 422 | + | + | − | L44R/L158G/K206A/F217R/N247D/Q302K/L316D/ M322I/A337P/K362Q/E367N/R373K | 463 |
| 423 | + | + | + | L44R/R162A/K206A/F217R/N247D/Q302K/L316D/ M322I/A337P/K362Q/E367N/R373K | 464 |
| 424 | + | + | − | L44R/K206A/F217R/N247D/L255E/Q302K/L316D/ M322I/A337P/K362Q/E367N/R373K | 465 |
| 425 | + | − | + | L44R/K206A/F217R/N247D/H271E/Q302K/L316D/ M322I/A337P/K362Q/E367N/R373K | 466 |
| 426 | + | − | − | L44R/K206A/F217R/N247D/M259E/Q302K/L316D/ M322I/A337P/K362Q/E367N/R373K | 467 |
| 427 | + | − | − | L44R/K206A/F217R/N247D/L263G/Q302K/L316D/ M322I/A337P/K362Q/E367N/R373K | 468 |
| 428 | + | + | − | L44R/K206A/F217R/N247D/M259S/Q302K/L316D/ M322I/A337P/K362Q/E367N/R373K | 469 |
| 429 | + | + | − | L44R/K206A/F217R/N247D/L255C/Q302K/L316D/ M322I/A337P/K362Q/E367N/R373K | 470 |
| 430 | + | − | + | L44R/K206A/F217R/N247D/H271T/Q302K/L316D/ M322I/A337P/K362Q/E367N/R373K | 471 |
| 431 | + | − | − | L44R/K206A/F217R/N247D/R270G/Q302K/L316D/ M322I/A337P/K362Q/E367N/R373K | 472 |
| 432 | + | − | + | L44R/K206A/F217R/N247D/L255V/Q302K/L316D/ M322I/A337P/K362Q/E367N/R373K | 473 |
| 433 | + | + | + | L44R/K206A/F217R/N247D/H271Q/Q302K/L316D/ M322I/A337P/K362Q/E367N/R373K | 474 |
| 434 | + | − | − | L44R/K206A/F217R/N247D/R270D/Q302K/L316D/ M322I/A337P/K362Q/E367N/R373K | 475 |
| 435 | + | ++ | − | L44R/K206A/F217R/N247D/I258L/Q302K/L316D/ M322I/A337P/K362Q/E367N/R373K | 476 |
| 436 | + | − | − | L44R/K206A/F217R/N247D/H271G/Q302K/L316D/ M322I/A337P/K362Q/E367N/R373K | 477 |
| 437 | + | + | − | L44R/K206A/F217R/N247D/L263E/Q302K/L316D/ M322I/A337P/K362Q/E367N/R373K | 478 |
| 438 | − | − | − | L44R/K206A/F217R/N247D/L255*/Q302K/L316D/ M322I/A337P/K362Q/E367N/R373K | 479 |
| 439 | + | + | + | L44R/K206A/F217R/N247D/H271A/Q302K/L316D/ M322I/A337P/K362Q/E367N/R373K | 480 |
| 440 | + | + | − | L44R/K206A/F217R/N247D/L263C/Q302K/L316D/ M322I/A337P/K362Q/E367N/R373K | 481 |
| 441 | + | − | + | L44R/K206A/F217R/N247D/H271V/Q302K/L316D/ M322I/A337P/K362Q/E367N/R373K | 482 |
| 442 | + | + | − | L44R/K206A/F217R/N247D/L255A/Q302K/L316D/ M322I/A337P/K362Q/E367N/R373K | 483 |
| 443 | + | +++ | − | L44R/K206A/F217R/N247D/L255S/Q302K/L316D/ M322I/A337P/K362Q/E367N/R373K | 484 |
| 444 | + | − | + | L44R/K206A/F217R/N247D/M259W/Q302K/L316D/ M322I/A337P/K362Q/E367N/R373K | 485 |
| 445 | + | + | − | L44R/K206A/F217R/N247D/L263Q/Q302K/L316D/ M322I/A337P/K362Q/E367N/R373K | 486 |
| 446 | + | − | − | L44R/K206A/F217R/N247D/M259A/Q302K/L316D/ M322I/A337P/K362Q/E367N/R373K | 487 |
| 447 | + | − | − | L44R/K206A/F217R/N247D/L263W/Q302K/L316D/ M322I/A337P/K362Q/E367N/R373K | 488 |
| 448 | + | − | − | L44R/K206A/F217R/N247D/R270Q/Q302K/L316D/ M322I/A337P/K362Q/E367N/R373K | 489 |
| 449 | + | ++ | − | L44R/K206A/F217R/N247D/L255I/Q302K/L316D/ M322I/A337P/K362Q/E367N/R373K | 490 |
| 450 | + | ++ | − | L44R/K206A/F217R/N247D/I258M/Q302K/L316D/ M322I/A337P/K362Q/E367N/R373K | 491 |
| 451 | + | ++ | − | L44R/K206A/F217R/N247D/M259V/Q302K/L316D/ M322I/A337P/K362Q/E367N/R373K | 492 |

TABLE 2.6-continued

Relative Activity of GLA Variants After No Challenge (NC) or Challenge at the Indicated pH or Condition [1,2,3,4]

| Variant # | NC | pH 3.7 | pH 9.65 | Amino acid differences relative to SEQ ID NO: 5 (WT GLA) | SEQ ID NO: |
|---|---|---|---|---|---|
| 452 | + | ++ | + | L44R/K206A/F217R/N247D/H271R/Q302K/L316D/M322I/A337P/K362Q/E367N/R373K | 493 |
| 453 | + | − | − | L44R/K206A/F217R/N247D/R270L/Q302K/L316D/M322I/A337P/K362Q/E367N/R373K | 494 |
| 454 | + | ++ | + | L44R/K206A/F217R/N247D/Q302K/L316D/M322I/A337P/K362Q/E367N/R373K/M390P | 495 |
| 455 | + | + | + | L44R/K206A/F217R/N247D/Q302K/L316D/M322I/A337P/K362Q/E367N/R373K/M392D | 496 |
| 456 | + | + | + | L44R/K206A/F217R/N247D/Q302K/L316D/M322I/A337P/K362Q/E367N/R373K/T389M | 497 |
| 457 | + | + | + | L44R/K206A/F217R/N247D/Q302K/L316D/M322I/A337P/K362Q/E367N/R373K/M392A | 498 |
| 458 | + | + | + | L44R/K206A/F217R/N247D/Q302K/L316D/M322I/A337P/K362Q/E367N/R373K/M390* | 499 |
| 459 | + | ++ | + | L44R/K206A/F217R/N247D/Q302K/L316D/M322I/A337P/K362Q/E367N/R373K/M390H | 500 |
| 460 | + | + | + | L44R/K206A/F217R/N247D/Q302K/L316D/M322I/A337P/K362Q/E367N/R373K/L386T | 501 |
| 461 | + | + | + | L44R/K206A/F217R/N247D/Q302K/L316D/M322I/A337P/K362Q/E367N/R373K/M392Q | 502 |
| 462 | + | + | + | L44R/K206A/F217R/N247D/Q302K/L316D/M322I/A337P/K362Q/E367N/R373K/Q385L | 503 |
| 463 | + | + | + | L44R/K206A/F217R/N247D/Q302K/L316D/M322I/A337P/K362Q/E367N/R373K/M390T | 504 |
| 464 | + | + | + | L44R/K206A/F217R/N247D/Q302K/L316D/M322I/A337P/K362Q/E367N/R373K/M392* | 505 |
| 465 | + | + | + | L44R/K206A/F217R/N247D/Q302K/L316D/M322I/A337P/K362Q/E367N/R373K/M390Q | 506 |
| 466 | + | + | + | L44R/K206A/F217R/N247D/Q302K/L316D/M322I/A337P/K362Q/E367N/R373K/M392E | 507 |
| 467 | + | + | + | L44R/K206A/F217R/N247D/Q302K/L316D/M322I/A337P/K362Q/E367N/R373K/T389S | 508 |
| 468 | + | + | + | L44R/K206A/F217R/N247D/Q302K/L316D/M322I/A337P/K362Q/E367N/R373K/T389Q | 509 |
| 469 | + | + | + | L44R/K206A/F217R/N247D/Q302K/L316D/M322I/A337P/K362Q/E367N/R373K/Q385I | 510 |
| 470 | + | ++ | + | L44R/K206A/F217R/N247D/Q302K/L316D/M322I/A337P/K362Q/E367N/R373K/M392R | 511 |
| 471 | + | + | + | L44R/K206A/F217R/N247D/Q302K/L316D/M322I/A337P/K362Q/E367N/R373K/T389W | 512 |
| 472 | + | + | + | L44R/K206A/F217R/N247D/Q302K/L316D/M322I/A337P/K362Q/E367N/R373K/M392K | 513 |
| 473 | + | + | + | L44R/K206A/F217R/N247D/Q302K/L316D/M322I/A337P/K362Q/E367N/R373K/M392L | 514 |
| 474 | + | ++ | + | L44R/K206A/F217R/N247D/Q302K/L316D/M322I/A337P/K362Q/E367N/R373K/L386F | 515 |
| 475 | + | + | + | L44R/K206A/F217R/N247D/Q302K/L316D/M322I/A337P/K362Q/E367N/R373K/T389D | 516 |
| 476 | + | + | + | L44R/K206A/F217R/N247D/Q302K/L316D/M322I/A337P/K362Q/E367N/R373K/M390E | 517 |
| 477 | + | − | + | L44R/K206A/F217R/N247D/Q302K/L316D/M322I/A337P/K362Q/E367N/R373K/L384W | 518 |
| 478 | + | ++ | + | L44R/K206A/F217R/N247D/Q302K/L316D/M322I/A337P/K362Q/E367N/R373K/M392S | 519 |
| 479 | + | + | + | L44R/K206A/F217R/N247D/Q302K/L316D/M322I/A337P/K362Q/E367N/R373K/M392F | 520 |
| 480 | + | + | + | L44R/K206A/F217R/N247D/Q302K/L316D/M322I/A337P/K362Q/E367N/R373K/M390R | 521 |
| 481 | + | + | + | L44R/K206A/F217R/N247D/Q302K/L316D/M322I/A337P/K362Q/E367N/R373K/M390G | 522 |
| 482 | + | + | + | L44R/K206A/F217R/N247D/Q302K/L316D/M322I/A337P/K362Q/E367N/R373K/Q385G | 523 |
| 483 | + | + | + | L44R/K206A/F217R/N247D/Q302K/L316D/M322I/A337P/K362Q/E367N/R373K/M392C | 524 |
| 484 | + | + | + | L44R/K206A/F217R/N247D/Q302K/L316D/M322I/A337P/K362Q/E367N/R373K/M392V | 525 |
| 485 | + | + | + | L44R/K206A/F217R/N247D/Q302K/L316D/M322I/A337P/K362Q/E367N/R373K/M392W | 526 |
| 486 | + | + | + | L44R/K206A/F217R/N247D/Q302K/L316D/M322I/A337P/K362Q/E367N/R373K/M390C | 527 |
| 487 | + | + | + | L44R/K206A/F217R/N247D/Q302K/L316D/M322I/A337P/K362Q/E367N/R373K/T389G | 528 |
| 488 | + | + | + | L44R/K206A/F217R/N247D/Q302K/L316D/M322I/A337P/K362Q/E367N/R373K/T389N | 529 |

TABLE 2.6-continued

Relative Activity of GLA Variants After No Challenge (NC)
or Challenge at the Indicated pH or Condition [1, 2, 3, 4]

| Variant # | NC | pH 3.7 | pH 9.65 | Amino acid differences relative to SEQ ID NO: 5 (WT GLA) | SEQ ID NO: |
|---|---|---|---|---|---|
| 489 | + | + | + | L44R/K206A/F217R/N247D/Q302K/L316D/M322I/A337P/K362Q/E367N/R373K/T389I | 530 |
| 490 | + | + | + | L44R/K206A/F217R/N247D/Q302K/L316D/M322I/A337P/K362Q/E367N/R373K/M390D | 531 |
| 491 | + | + | + | L44R/K206A/F217R/N247D/Q302K/L316D/M322I/A337P/K362Q/E367N/R373K/M390W | 532 |
| 492 | + | + | + | L44R/K206A/F217R/N247D/Q302K/L316D/M322I/A337P/K362Q/E367N/R373K/T389C | 533 |
| 493 | + | + | + | L44R/K206A/F217R/N247D/Q302K/L316D/M322I/A337P/K362Q/E367N/R373K/M392P | 534 |
| 494 | + | + | + | L44R/K206A/F217R/N247D/Q302K/L316D/M322I/A337P/K362Q/E367N/R373K/M390F | 535 |
| 495 | + | + | + | L44R/K206A/F217R/N247D/Q302K/L316D/M322I/A337P/K362Q/E367N/R373K/T389P | 536 |
| 496 | + | + | + | L44R/K206A/F217R/N247D/Q302K/L316D/M322I/A337P/K362Q/E367N/R373K/M390V | 537 |
| 497 | + | ++ | + | L44R/K206A/F217R/N247D/Q302K/L316D/M322I/A337P/K362Q/E367N/R373K/M390K | 538 |
| 498 | + | + | + | L44R/K206A/F217R/N247D/Q302K/L316D/M322I/A337P/K362Q/E367N/R373K/M392I | 539 |
| 499 | + | + | + | L44R/K206A/F217R/N247D/Q302K/L316D/M322I/A337P/K362Q/E367N/R373K/T389L | 540 |
| 500 | + | + | + | L44R/K206A/F217R/N247D/Q302K/L316D/M322I/A337P/K362Q/E367N/R373K/M390A | 541 |
| 501 | + | ++ | + | L44R/K206A/F217R/N247D/Q302K/L316D/M322I/A337P/K362Q/E367N/R373K/M392G | 542 |
| 502 | − | + | − | L44R/K206A/F217R/N247D/Q302K/L316D/M322I/A337P/K362Q/E367N/R373K/L386S | 543 |
| 503 | + | + | + | L44R/K206A/F217R/N247D/Q302K/L316D/M322I/A337P/K362Q/E367N/R373K/Q385C | 544 |
| 504 | + | + | + | L44R/K206A/F217R/N247D/Q302K/L316D/M322I/A337P/K362Q/E367N/R373K/M390S | 545 |
| 505 | + | + | + | L44R/K206A/F217R/N247D/Q302K/L316D/M322I/A337P/K362Q/E367N/R373K/M392N | 546 |
| 506 | + | + | − | L44R/K206A/F217R/N247D/Q302K/L316D/M322I/A337P/K362Q/E367N/R373K/Q385W | 547 |
| 507 | + | ++ | + | L44R/K206A/F217R/N247D/Q302K/L316D/M322I/A337P/K362Q/E367N/R373K/M392T | 548 |
| 508 | − | − | − | L44R/K206A/F217R/N247D/Q302K/L316D/M322I/A337P/K362Q/E367N/R373K/L384A | 549 |
| 509 | + | + | + | L44R/K206A/F217R/N247D/Q302K/L316D/M322I/A337P/K362Q/E367N/R373K/Q385T | 550 |
| 510 | + | − | + | L44R/A199G/K206A/F217R/N247D/Q302K/L316D/M322I/A337P/K362Q/E367N/R373K/M392R | 551 |
| 511 | + | + | + | L44R/K206A/F217R/N247D/Q302K/L316D/M322I/A337P/K362Q/E367N/R373K/L397* | 552 |
| 512 | + | + | + | L44R/K206A/F217R/N247D/Q302K/L316D/M322I/A337P/K362Q/E367N/R373K/K395* | 553 |
| 513 | + | + | + | L44R/K206A/F217R/N247D/Q302K/L316D/M322I/A337P/K362Q/E367N/R373K/D396* | 554 |
| 514 | + | + | + | L44R/K206A/F217R/N247D/Q302K/L316D/M322I/A337P/K362Q/E367N/R373K/S393* | 555 |
| 515 | + | + | + | L44R/K206A/F217R/N247D/Q302K/L316D/M322I/A337P/K362Q/E367N/R373K/L394* | 556 |

[1] Relative activity was calculated as activity of the variant/activity of Rd4BB (SEQ ID NO: 15 (encoded by SEQ ID NO: 14).
[2] Variant # 395 (Rd5BB) has the polynucleotide sequence of SEQ ID NO: 39 and polypeptide sequence of SEQ ID NO: 40.
[3] Variant # 402 (Rd6BB) has the polynucleotide sequence of SEQ ID NO: 41 and polypeptide sequence of SEQ ID NO: 42
[4] − = <0.5 relative activity to Rd4BB (SEQ ID NO: 15); + = 0.5 to 1.5 relative activity over Rd4BB (SEQ ID NO: 15); ++ = >1.5 to 2.5 relative activity over Rd4BB (SEQ ID NO: 15); and +++ = >2.5 relative activity over Rd4BB (SEQ ID NO: 15).

TABLE 2.7

Relative Activity of GLA Variants After No Challenge
(NC) or Challenge at the Indicated pH or Condition

| Variant # | NC | pH 3.7 | pH 9.7 | Amino acid differences relative to SEQ ID NO: 5 (WT GLA) | SEQ ID NO: |
|---|---|---|---|---|---|
| 516 | + | +++ | + | D2E/L44R/Y92H/K206A/F217R/N247D/Q302K/L316D/M322I/Q326G/A337P/K362Q/E367N/R373K | 557 |

TABLE 2.7-continued

Relative Activity of GLA Variants After No Challenge
(NC) or Challenge at the Indicated pH or Condition

| Variant # | NC | pH 3.7 | pH 9.7 | Amino acid differences relative to SEQ ID NO: 5 (WT GLA) | SEQ ID NO: |
|---|---|---|---|---|---|
| 517 | + | + | + | D2Q/L44R/Y92H/K206A/F217R/N247D/Q302K/L316D/M322I/A337P/K362Q/E367N/R373K | 558 |
| 518 | + | + | ++ | E40D/L44R/Y92H/K206A/F217R/N247D/Q302K/L316D/M322I/A337P/K362Q/E367N/R373K | 559 |
| 519 | + | + | ++ | E40S/L44R/Y92H/K206A/F217R/N247D/Q302K/L316D/M322I/A337P/K362Q/E367N/R373K | 560 |
| 520 | + | + | + | L44R/A77S/Y92H/K206A/F217R/N247D/Q302K/L316D/M322I/A337P/K362Q/E367N/R373K | 561 |
| 521 | + | + | ++ | L44R/D52N/Y92H/K206A/F217R/N247D/Q302K/L316D/M322I/A337P/K362Q/E367N/R373K | 562 |
| 522 | + | +++ | ++ | L44R/E56K/Y92H/K206A/F217R/N247D/Q302K/L316D/M322I/A337P/K362Q/E367N/R373K | 563 |
| 523 | + | + | + | L44R/N91M/Y92H/K206A/F217R/N247D/Q302K/L316D/M322I/A337P/K362Q/E367N/R373K | 564 |
| 524 | − | + | + | L44R/N91V/Y92H/K206A/F217R/N247D/Q302K/L316D/M322I/A337P/K362Q/E367N/R373K | 565 |
| 525 | + | ++ | ++ | L44R/Q76H/Y92H/K206A/F217R/N247D/Q302K/L316D/M322I/A337P/K362Q/E367N/W368A/R373K | 566 |
| 526 | + | + | ++ | L44R/R74H/Y92H/K206A/F217R/N247D/Q302K/L316D/M322I/A337P/K362Q/E367N/R373K | 567 |
| 527 | + | + | ++ | L44R/Y92E/K206A/F217R/N247D/Q302K/L316D/M322I/A337P/K362Q/E367N/R373K | 568 |
| 528 | + | + | ++ | L44R/Y92H/D130Q/K206A/F217R/N247D/Q302K/L316D/M322I/A337P/K362Q/E367N/R373K | 569 |
| 529 | + | + | ++ | L44R/Y92H/K182A/K206A/F217R/N247D/Q302K/L316D/M322I/A337P/K362Q/E367N/R373K | 570 |
| 530 | + | + | ++ | L44R/Y92H/K182E/K206A/F217R/N247D/Q302K/L316D/M322I/A337P/K362Q/E367N/R373K | 571 |
| 531 | + | + | ++ | L44R/Y92H/K182H/K206A/F217R/N247D/Q302K/L316D/M322I/A337P/K362Q/E367N/R373K | 572 |
| 532 | + | + | ++ | L44R/Y92H/K182M/K206A/F217R/N247D/Q302K/L316D/M322I/A337P/K362Q/E367N/R373K | 573 |
| 533 | + | + | ++ | L44R/Y92H/K182Q/K206A/F217R/N247D/Q302K/L316D/M322I/A337P/K362Q/E367N/R373K | 574 |
| 534 | + | + | ++ | L44R/Y92H/K182R/K206A/F217R/N247D/Q302K/L316D/M322I/A337P/K362Q/E367N/R373K | 575 |
| 535 | + | + | ++ | L44R/Y92H/K182T/K206A/F217R/N247D/Q302K/L316D/M322I/A337P/K362Q/E367N/R373K | 576 |
| 536 | + | + | ++ | L44R/Y92H/K182V/K206A/F217R/N247D/Q302K/L316D/M322I/A337P/K362Q/E367N/R373K | 577 |
| 537 | + | + | ++ | L44R/Y92H/K182Y/K206A/F217R/N247D/Q302K/L316D/M322I/A337P/K362Q/E367N/R373K | 578 |
| 538 | + | + | + | L44R/Y92H/K206A/F217R/N247D/A287C/Q302K/L316D/M322I/A337P/K362Q/E367N/R373K | 579 |
| 539 | + | + | ++ | L44R/Y92H/K206A/F217R/N247D/A287H/Q302K/L316D/M322I/A337P/K362Q/E367N/R373K | 580 |
| 540 | + | + | ++ | L44R/Y92H/K206A/F217R/N247D/A287M/Q302K/L316D/M322I/A337P/K362Q/E367N/R373K | 581 |
| 541 | + | + | ++ | L44R/Y92H/K206A/F217R/N247D/K283A/Q302K/L316D/M322I/A337P/K362Q/E367N/R373K | 582 |
| 542 | + | + | ++ | L44R/Y92H/K206A/F217R/N247D/K283G/Q302K/L316D/M322I/A337P/K362Q/E367N/R373K | 583 |
| 543 | + | + | + | L44R/Y92H/K206A/F217R/N247D/K283M/Q302K/L316D/M322I/A337P/K362Q/E367N/R373K | 584 |
| 544 | + | + | + | L44R/Y92H/K206A/F217R/N247D/K283V/Q302K/L316D/M322I/A337P/K362Q/E367N/R373K | 585 |
| 545 | + | + | ++ | L44R/Y92H/K206A/F217R/N247D/K295A/Q302K/L316D/M322I/A337P/K362Q/E367N/R373K | 586 |
| 546 | + | +++ | ++ | L44R/Y92H/K206A/F217R/N247D/K295E/Q302K/L316D/M322I/A337P/K362Q/E367N/R373K | 587 |
| 547 | + | + | ++ | L44R/Y92H/K206A/F217R/N247D/K295L/Q302K/L316D/M322I/A337P/K362Q/E367N/R373K | 588 |
| 548 | + | +++ | ++ | L44R/Y92H/K206A/F217R/N247D/K295N/Q302K/L316D/M322I/A337P/K362Q/E367N/R373K | 589 |
| 549 | + | ++ | ++ | L44R/Y92H/K206A/F217R/N247D/K295Q/Q302K/L316D/M322I/A337P/K362Q/E367N/R373K | 590 |
| 550 | + | + | ++ | L44R/Y92H/K206A/F217R/N247D/K295S/Q302K/L316D/M322I/A337P/K362Q/E367N/R373K | 591 |
| 551 | + | + | ++ | L44R/Y92H/K206A/F217R/N247D/K295T/Q302K/L316D/M322I/A337P/K362Q/E367N/R373K | 592 |
| 552 | + | + | ++ | L44R/Y92H/K206A/F217R/N247D/Q302K/L316D/A317D/M322I/A337P/K362Q/E367N/R373K | 593 |
| 553 | + | + | ++ | L44R/Y92H/K206A/F217R/N247D/Q302K/L316D/A317Q/M322I/A337P/K362Q/E367N/R373K | 594 |

TABLE 2.7-continued

Relative Activity of GLA Variants After No Challenge
(NC) or Challenge at the Indicated pH or Condition

| Variant # | NC | pH 3.7 | pH 9.7 | Amino acid differences relative to SEQ ID NO: 5 (WT GLA) | SEQ ID NO: |
|---|---|---|---|---|---|
| 554 | + | + | ++ | L44R/Y92H/K206A/F217R/N247D/Q302K/L316D/M322I/A337P/A346G/K362Q/E367N/R373K | 595 |
| 555 | + | + | + | L44R/Y92H/K206A/F217R/N247D/Q302K/L316D/M322I/A337P/G344A/K362Q/E367N/R373K | 596 |
| 556 | − | − | + | L44R/Y92H/K206A/F217R/N247D/Q302K/L316D/M322I/A337P/G344D/K362Q/E367N/R373K | 597 |
| 557 | + | + | ++ | L44R/Y92H/K206A/F217R/N247D/Q302K/L316D/M322I/A337P/G344S/K362Q/E367N/R373K | 598 |
| 558 | − | − | + | L44R/Y92H/K206A/F217R/N247D/Q302K/L316D/M322I/A337P/I353L/K362Q/E367N/R373K | 599 |
| 559 | + | + | ++ | L44R/Y92H/K206A/F217R/N247D/Q302K/L316D/M322I/A337P/K362Q/E367N/L372W/R373K | 600 |
| 560 | + | ++ | ++ | L44R/Y92H/K206A/F217R/N247D/Q302K/L316D/M322I/A337P/K362Q/E367N/W368A/R373K | 601 |
| 561 | + | + | ++ | L44R/Y92H/K206A/F217R/N247D/Q302K/L316D/M322I/A337P/K362Q/E367N/W368L/R373K | 602 |
| 562 | + | + | ++ | L44R/Y92H/K206A/F217R/N247D/Q302K/L316D/M322I/A337P/K362Q/E367N/W368N/R373K | 603 |
| 563 | + | + | ++ | L44R/Y92H/K206A/F217R/N247D/Q302K/L316D/M322I/A337P/K362Q/E367N/W368R/R373K | 604 |
| 564 | + | + | ++ | L44R/Y92H/K206A/F217R/N247D/Q302K/L316D/M322I/A337P/K362Q/E367N/W368V/R373K | 605 |
| 565 | + | + | ++ | L44R/Y92H/K206A/F217R/N247D/Q302K/L316D/M322I/A337P/N348E/K362Q/E367N/R373K | 606 |
| 566 | + | + | ++ | L44R/Y92H/K206A/F217R/N247D/Q302K/L316D/M322I/A337P/N348M/K362Q/E367N/R373K | 607 |
| 567 | + | + | ++ | L44R/Y92H/K206A/F217R/N247D/Q302K/L316D/M322I/A337P/N348Q/K362Q/E367N/R373K | 608 |
| 568 | + | + | ++ | L44R/Y92H/K206A/F217R/N247D/Q302K/L316D/M322I/A337P/N348R/K362Q/E367N/R373K | 609 |
| 569 | + | + | ++ | L44R/Y92H/K206A/F217R/N247D/Q302K/L316D/M322I/A337P/N348W/K362Q/E367N/R373K | 610 |
| 570 | + | + | ++ | L44R/Y92H/K206A/F217R/N247D/Q302K/L316D/M322I/A337P/T354S/K362Q/E367N/R373K | 611 |
| 571 | + | + | ++ | L44R/Y92H/K206A/F217R/N247D/Q302K/N305K/L316D/M322I/A337P/K362Q/E367N/R373K | 612 |
| 572 | + | +++ | ++ | L44R/Y92H/K206A/F217R/N247D/Q302K/N305L/L316D/M322I/A337P/K362Q/E367N/R373K | 613 |
| 573 | + | + | ++ | L44R/Y92H/K206A/F217R/N247D/Q302K/S314A/L316D/M322I/A337P/K362Q/E367N/R373K | 614 |
| 574 | + | + | ++ | L44R/Y92H/K206A/F217R/N247D/Q302K/S314H/L316D/M322I/A337P/K362Q/E367N/R373K | 615 |
| 575 | + | + | ++ | L44R/Y92H/K206A/F217R/N247D/Q302K/S314N/L316D/M322I/A337P/K362Q/E367N/R373K | 616 |
| 576 | + | + | ++ | L44R/Y92H/K206A/F217R/N247D/Q302K/S314Y/L316D/M322I/A337P/K362Q/E367N/R373K | 617 |
| 577 | + | +++ | ++ | L44R/Y92H/K206A/F217R/W246A/N247D/Q302K/L316D/M322I/A337P/K362Q/E367N/R373K | 618 |
| 578 | + | +++ | ++ | L44R/Y92H/K206A/F217R/W246I/N247D/Q302K/L316D/M322I/A337P/K362Q/E367N/R373K | 619 |
| 579 | + | +++ | ++ | L44R/Y92H/K206A/F217R/W246P/N247D/Q302K/L316D/M322I/A337P/K362Q/E367N/R373K | 620 |
| 580 | + | +++ | ++ | L44R/Y92H/K206A/F217R/W246R/N247D/Q302K/L316D/M322I/A337P/K362Q/E367N/R373K | 621 |
| 581 | + | ++ | ++ | L44R/Y92H/K206A/F217R/W246S/N247D/Q302K/L316D/M322I/A337P/K362Q/E367N/R373K | 622 |
| 582 | + | + | ++ | L44R/Y92H/K206A/S210A/F217R/N247D/Q302K/L316D/M322I/A337P/A350T/K362Q/E367N/R373K | 623 |
| 583 | + | + | ++ | L44R/Y92H/K206A/S210A/F217R/N247D/Q302K/L316D/M322I/A337P/K362Q/E367N/R373K | 624 |
| 584 | + | + | ++ | L44R/Y92H/K206A/S210E/F217R/N247D/Q302K/L316D/M322I/A337P/K362Q/E367N/R373K | 625 |
| 585 | + | + | ++ | L44R/Y92H/K206A/S210K/F217R/N247D/Q302K/L316D/M322I/A337P/K362Q/E367N/R373K | 626 |
| 586 | + | ++ | ++ | L44R/Y92H/K206A/S210N/F217R/N247D/Q302K/L316D/M322I/A337P/K362Q/E367N/R373K | 627 |
| 587 | + | + | ++ | L44R/Y92H/K206A/S210R/F217R/N247D/Q302K/L316D/M322I/A337P/K362Q/E367N/R373K | 628 |
| 588 | + | + | + | L44R/Y92H/K96A/K206A/F217R/N247D/Q302K/L316D/M322I/A337P/K362Q/E367N/R373K | 629 |
| 589 | + | + | + | L44R/Y92H/K96W/K206A/F217R/N247D/Q302K/L316D/M322I/A337P/K362Q/E367N/R373K | 630 |
| 590 | + | + | + | L44R/Y92H/P179M/K206A/F217R/N247D/Q302K/L316D/M322I/A337P/K362Q/E367N/R373K | 631 |

TABLE 2.7-continued

Relative Activity of GLA Variants After No Challenge (NC) or Challenge at the Indicated pH or Condition

| Variant # | NC | pH 3.7 | pH 9.7 | Amino acid differences relative to SEQ ID NO: 5 (WT GLA) | SEQ ID NO: |
|---|---|---|---|---|---|
| 591 | + | + | ++ | L44R/Y92H/R189K/K206A/F217R/N247D/Q302K/L316D/M322I/A337P/K362Q/E367N/R373K | 632 |
| 592 | + | + | ++ | L44R/Y92H/R189V/K206A/F217R/N247D/Q302K/L316D/M322I/A337P/K362Q/E367N/R373K | 633 |
| 593 | + | + | ++ | L44R/Y92H/S95A/K206A/F217R/N247D/Q302K/L316D/M322I/A337P/K362Q/E367N/R373K | 634 |
| 594 | + | + | ++ | L44R/Y92H/S95E/K206A/F217R/N247D/Q302K/L316D/M322I/A337P/K362Q/E367N/R373K | 635 |
| 595 | + | + | + | L44R/Y92H/T186A/K206A/F217R/N247D/Q302K/L316D/M322I/A337P/K362Q/E367N/R373K | 636 |
| 596 | + | ++ | ++ | L44R/Y92H/T186G/K206A/F217R/N247D/Q302K/L316D/M322I/A337P/K362Q/E367N/R373K | 637 |
| 597 | + | − | + | L44R/Y92H/T186V/K206A/F217R/N247D/Q302K/L316D/M322I/A337P/K362Q/E367N/R373K | 638 |
| 598 | + | + | ++ | L44R/Y92H/Y120H/K206A/F217R/N247D/Q302K/L316D/M322I/A337P/K362Q/E367N/R373K | 639 |
| 599 | + | + | ++ | L44R/Y92H/Y120S/K206A/F217R/N247D/Q302K/L316D/M322I/A337P/K362Q/E367N/R373K | 640 |
| 600 | + | +++ | + | L44R/Y92H/Y120S/K206A/F217R/N247D/Q302K/L316D/M322I/A337P/L341F/K362Q/E367N/R373K | 641 |
| 601 | − | + | + | M39C/L44R/Y92H/K206A/F217R/N247D/Q302K/L316D/M322I/A337P/K362Q/E367N/R373K | 642 |
| 602 | + | + | ++ | M39E/L44R/Y92H/K206A/F217R/N247D/Q302K/L316D/M322I/A337P/K362Q/E367N/R373K | 643 |
| 603 | + | + | + | M39R/L44R/Y92H/K206A/F217R/N247D/Q302K/L316D/M322I/A337P/K362Q/E367N/R373K | 644 |
| 604 | + | + | ++ | M39V/L44R/Y92H/K206A/F217R/N247D/Q302K/L316D/M322I/A337P/K362Q/E367N/R373K | 645 |
| 605 | + | +++ | ++ | T10P/L44R/Y92H/K206A/F217R/N247D/Q302K/L316D/M322I/A337P/K362Q/E367N/R373K | 646 |
| 606 | + | +++ | ++ | T10P; L44R; Y92H; R189L; K206A; F217R; N247D; Q302K; L316D; M322I; A337P; K362Q; E367N; R373K | 647 |
| 607 | + | + | ++ | T8L; L44R; Y92H; K206A; F217R; N247D; Q302K; L316D; M322I; A337P; K362Q; E367N; R373K | 648 |
| 608 | + | + | + | T8Q; L44R; Y92H; K206A; F217R; N247D; Q302K; L316D; M322I; A337P; K362Q; E367N; R373K | 649 |

1. Relative activity was calculated as activity of the variant/activity of Rd3BB (SEQ ID NO: 13) (encoded by SEQ ID NO: 11).
2. − = <1.5 relative activity to Rd3BB (SEQ ID NO: 13); + = 1.5 to 5 relative activity over Rd3BB (SEQ ID NO: 13); ++ = >5 to 10 relative activity over Rd3BB (SEQ ID NO: 13); and +++ = >10 relative activity over Rd3BB (SEQ ID NO: 13).

TABLE 2.8

Relative Activity of GLA Variants After No Challenge (NC) or Challenge at the Indicated pH or Condition

| Variant # | NC | pH 3.3 | pH 9.7 | Amino acid differences relative to SEQ ID NO: 5 (WT GLA) | SEQ ID NO: |
|---|---|---|---|---|---|
| 609 | + | ++ | ++ | L44R/S166P/K206A/F217R/N247D/Q302K/L316D/M322I/A337P/K362Q/E367N/R373K | 650 |
| 610 | + | + | − | L44R/S47T/Y92H/S166P/K206A/F217R/N247D/M259E/Q302K/L316D/M322I/A337P/K362Q/E367N/R373K/M390Q | 651 |
| 611 | + | +++ | ++ | L44R/Y92H/S166P/K206A/F217R/N247D/Q302K/L316D/M322I/A337P/K362Q/E367N/R373K/M390Q | 652 |
| 612 | + | ++ | ++ | L44R/Y92H/S166P/K206A/F217R/N247D/Q302K/L316D/M322I/A337P/K362Q/E367N/R373K/M392T | 653 |
| 613 | + | ++ | ++ | L44R/S47N/Y92H/S166P/K206A/F217R/N247D/H271A/Q302K/L316D/M322I/A337P/K362Q/E367N/R373K/M390Q | 654 |
| 614 | + | ++ | ++ | L44R/S47T/Y92H/S166P/K206A/F217R/N247D/Q302K/L316D/M322I/A337P/K362Q/E367N/R373K | 655 |
| 615 | + | ++ | ++ | L44R/S47N/Y92H/S166P/K206A/F217R/N247D/Q302K/L316D/M322I/A337P/K362Q/E367N/R373K/M390H | 656 |
| 616 | + | + | ++ | L44R/S47T/Y92H/S166P/K206A/F217R/N247D/M259W/H271A/Q302K/L316D/M322I/A337P/K362Q/E367N/R373K/M390Q | 657 |
| 617 | + | ++ | ++ | L44R/Y92H/L136V/S166P/K206A/F217R/N247D/M259A/Q302K/L316D/M322I/A337P/K362Q/E367N/R373K/M390Q | 658 |
| 618 | + | ++ | ++ | L44R/S47T/Y92H/S166P/K206A/F217R/N247D/H271A/Q302K/L316D/M322I/A337P/K362Q/E367N/R373K | 659 |
| 619 | + | ++ | ++ | L44R/S47T/Y92H/S166P/K206A/F217R/N247D/H271A/Q302K/L316D/M322I/A337P/K362Q/E367N/R373K/M390H | 660 |

TABLE 2.8-continued

Relative Activity of GLA Variants After No Challenge (NC) or Challenge at the Indicated pH or Condition

| Variant # | NC | pH 3.3 | pH 9.7 | Amino acid differences relative to SEQ ID NO: 5 (WT GLA) | SEQ ID NO: |
|---|---|---|---|---|---|
| 620 | − | + | ++ | L44R/S47T/Y92H/S166P/K206A/F217R/N247D/H271A/Q302K/L316D/M322I/A337P/K362N/E367N/R373K/M390Q | 661 |
| 621 | + | ++ | − | L44R/S47T/Y92H/S166P/K206A/F217R/N247D/M259E/H271A/Q302K/L316D/M322I/A337P/K362Q/E367N/R373K/M390Q | 662 |
| 622 | + | − | ++ | L44R/S47N/Y92H/S166P/K206A/F217R/N247D/M259W/H271A/Q302K/L316D/M322I/A337P/K362Q/E367N/R373K/M390Q/M392T | 663 |
| 623 | + | +++ | ++ | L44R/S47N/S166P/K206A/F217R/N247D/H271A/A276S/Q302K/L316D/M322I/A337P/K362Q/E367N/R373K/M392T | 664 |
| 624 | + | ++ | ++ | L44R/S47N/S166P/K206A/F217R/N247D/H271A/Q302K/L316D/M322I/A337P/K362Q/E367N/R373K/M390Q | 665 |
| 625 | + | ++ | ++ | L44R/S47T/Y92H/S166P/K206A/F217R/N247D/H271A/Q302K/L316D/M322I/A337P/K362Q/E367N/R373K/M392T | 44 |
| 626 | + | ++ | ++ | L44R/Y92H/S166P/K206A/F217R/N247D/H271A/Q302K/L316D/M322I/A337P/K362Q/E367N/R373K/M390Q | 666 |
| 627 | + | − | ++ | L44R/S47N/Y92H/S166P/K206A/F217R/N247D/M259W/H271A/Q302K/L316D/M322I/A337P/K362Q/E367N/R373K/M390H/M392T | 667 |
| 628 | + | + | ++ | L44R/S47N/Y92H/S166P/K206A/F217R/N247D/H271A/Q302K/L316D/M322I/A337P/K362Q/E367N/R373K/M390H | 668 |
| 629 | + | ++ | ++ | L44R/S47T/S166P/K206A/F217R/N247D/H271A/Q302K/L316D/M322I/A337P/K362Q/E367N/R373K/M390Q | 669 |
| 630 | + | − | ++ | L44R/S47T/Y92H/S166P/K206A/F217R/N247D/M259W/H271A/Q302K/L316D/M322I/A337P/K362Q/E367N/R373K/M390H | 670 |
| 631 | + | + | ++ | L44R/S47T/A53S/Y92H/S166P/K206A/F217R/N247D/H271A/Q302K/L316D/M322I/A337P/K362Q/E367N/R373K/M390Q | 671 |
| 632 | + | ++ | ++ | L44R/S47N/Y92H/S166P/K206A/F217R/N247D/H271A/Q302K/L316D/M322I/A337P/K362Q/E367N/R373K/M392T | 672 |
| 633 | + | ++ | ++ | E43D/L44R/Y92S/S166P/K206A/F217R/N247D/Q302K/L316D/M322I/A337P/K362Q/E367N/R373K | 673 |
| 634 | + | ++ | ++ | E43D/L44R/Y92E/S166P/K206A/F217R/N247D/Q302K/L316D/M322I/A337P/K362Q/E367N/R373K | 674 |
| 635 | + | ++ | ++ | E43D/L44R/Y92H/S166P/K206A/F217R/N247D/Q302K/L316D/M322I/A337P/K362Q/E367N/R373K | 675 |
| 636 | + | + | ++ | E43D/L44R/Y92N/S166P/K206A/F217R/N247D/Q302K/L316D/M322I/A337P/K362Q/E367N/R373K | 676 |
| 637 | + | + | ++ | E43Q/L44R/Y92E/S166P/K206A/F217R/N247D/Q302K/L316D/M322I/A337P/K362Q/E367N/R373K | 677 |

1. Relative activity was calculated as activity of the variant/activity of Rd3BB (SEQ ID NO: 13) (encoded by SEQ ID NO: 11).
2. Variant # 625 (Rd7BB) has the polynucleotide sequence of SEQ ID NO: 43 and polypeptide sequence of SEQ ID NO: 44.
3. − = <1.5 relative activity to Rd3BB (SEQ ID NO: 13); + = 1.5 to 5 relative activity over Rd3BB (SEQ ID NO: 13); ++ = >5 to 10 relative activity over Rd3BB (SEQ ID NO: 13); and +++ = >10 relative activity over Rd3BB (SEQ ID NO: 13).

TABLE 2.9

Relative Activity of GLA Variants After No Challenge (NC) or Challenge at the Indicated pH or Condition

| Variant # | NC | pH 3.5 | pH 7.5 | Amino acid differences relative to SEQ ID NO: 5 (WT GLA) | SEQ ID NO: |
|---|---|---|---|---|---|
| 638 | − | − | − | T10P/L44R/S47T/Y92H/S166P/K206A/F217R/N247D/A261G/H271A/Q302K/L316D/M322I/A337P/K362Q/E367N/R373K/M392T | 678 |
| 639 | − | − | − | M39E/L44R/S47T/Y92H/S166P/K206A/F217R/N247D/H271A/Q302K/L316D/M322I/A337P/K362Q/E367N/R373K/M392T | 679 |
| 640 | + | + | + | T10P/M39E/E43D/L44R/S47T/Y92H/S166P/K206A/F217R/N247D/H271A/Q302K/L316D/M322I/A337P/K362Q/E367N/R373K/M392T | 680 |
| 641 | − | − | − | T10P/M39E/L44R/S47T/Y92H/S166P/K206A/F217R/N247D/S266P/H271A/Q302K/L316D/M322I/A337P/K362Q/E367N/R373K/M392T | 681 |
| 642 | + | + | + | T10P/E43D/L44R/S47T/Y92H/S166P/K206A/F217R/N247D/A261G/H271A/Q302K/N305L/L316D/M322I/A337P/K362Q/E367N/W368A/R373K/M392T | 682 |
| 643 | + | − | + | T10P/L44R/S47T/Y92H/S166P/K206A/F217R/N247D/H271A/Q302K/L316D/M322I/R325S/A337P/K362Q/E367N/R373K/M392T | 683 |
| 644 | − | − | − | L44R/S47T/Y92H/S166P/K206A/F217R/L237P/N247D/H271A/Q302K/L316D/M322I/A337P/K362Q/E367N/R373K/M392T | 684 |
| 645 | + | + | − | L44R/S47T/Y92H/S166P/P174S/K206A/F217R/N247D/H271A/Q302K/L316D/M322I/A337P/K362Q/E367N/R373K/M392T | 685 |

TABLE 2.9-continued

Relative Activity of GLA Variants After No Challenge (NC) or Challenge at the Indicated pH or Condition

| Variant # | NC | pH 3.5 | pH 7.5 | Amino acid differences relative to SEQ ID NO: 5 (WT GLA) | SEQ ID NO: |
|---|---|---|---|---|---|
| 646 | − | − | − | L44R/S47T/Y92H/G113C/S166P/K206A/F217R/N247D/H271A/Q302K/L316D/M322I/A337P/K362Q/E367N/R373K/M392T | 686 |
| 647 | − | − | − | L14F/L44R/S47T/Y92H/S166P/K206A/F217R/N247D/H271A/Q302K/L316D/M322I/A337P/K362Q/E367N/R373K/M392T | 687 |
| 648 | + | + | + | T10P/M39E/L44R/S47T/Y92H/S166P/K206A/F217R/N247D/A261G/H271A/Q302K/L316D/M322I/A337P/K362Q/E367N/W368A/R373K/M392T | 46 |
| 649 | + | + | + | T10P/M39E/L44R/S47T/Y92H/S166P/K206A/F217R/W246P/N247D/H271A/Q302K/L316D/M322I/A337P/K362Q/E367N/R373K/M392T | 689 |
| 650 | + | + | + | R7H/T10P/L44R/S47T/Y92H/S166P/K206A/F217R/N247D/H271A/Q302K/L316D/M322I/A337P/K362Q/E367N/R373K/M392T | 690 |
| 651 | + | + | + | T10P/L44R/S47T/Y92H/S166P/K206A/F217R/N247D/H271A/Q302K/L316D/M322I/A337P/K362Q/E367N/R373K/M392T | 691 |
| 652 | + | + | − | L44R/S47T/Y92H/S166P/K206A/F217R/W246P/N247D/A261G/H271A/Q302K/N305L/L316D/M322I/A337P/K362Q/E367N/R373K/M392T | 692 |
| 653 | + | + | + | T10P/L44R/S47T/Y92H/S166P/K206A/F217R/W246P/N247D/H271A/Q302K/L316D/M322I/A337P/K362Q/E367N/R373K/M392T | 693 |
| 654 | + | + | + | R7S/L44R/S47T/Y92H/S166P/K206A/F217R/N247D/H271A/Q302K/L316D/M322I/A337P/K362Q/E367N/R373K/M392T | 694 |
| 655 | + | − | − | L44R/S47T/Y92H/S166P/K206A/F217R/W246P/N247D/A261G/H271A/Q302K/N305L/L316D/M322I/A337P/K362Q/E367N/W368A/R373K/M392T | 695 |
| 656 | + | + | + | T10P/L44R/S47T/Y92H/S166P/K206A/F217R/W246P/N247D/A261G/H271A/Q302K/L316D/M322I/A337P/K362Q/E367N/R373K/M392T | 696 |
| 657 | + | + | + | L44R/S47T/P67T/Y92H/S166P/K182N/K206A/F217R/N247D/H271A/Q302K/L316D/M322I/A337P/K362Q/E367N/R373K/M392T | 697 |
| 658 | + | + | + | M39E/L44R/S47T/Y92H/S166P/K206A/F217R/W246P/N247D/H271A/Q302K/L316D/M322I/A337P/K362Q/E367N/R373K/M392T | 698 |
| 659 | − | − | − | L44R/S47T/W64L/Y92H/S166P/K206A/F217R/N247D/H271A/Q302K/L316D/M322I/A337P/K362Q/E367N/R373K/M392T | 699 |
| 660 | + | + | − | M39E/L44R/S47T/Y92H/S166P/K206A/F217R/N247D/A261G/H271A/Q302K/N305L/L316D/M322I/A337P/K362Q/E367N/R373K/M392T | 700 |
| 661 | − | − | − | L44R/S47T/Y92H/S166P/W195C/K206A/F217R/N247D/H271A/Q302K/L316D/M322I/A337P/K362Q/E367N/R373K/M392T | 701 |
| 662 | + | + | + | L44R/S47T/Y92H/S166P/K206A/F217R/V238I/N247D/H271A/Q302K/L316D/M322I/A337P/K362Q/E367N/R373K/M392T | 702 |
| 663 | + | + | − | E43D/L44R/S47T/Y92H/S166P/K206A/F217R/N247D/A261G/H271A/Q302K/L316D/M322I/A337P/K362Q/E367N/W368A/R373K/M392T | 703 |
| 664 | − | − | − | T10P/L44R/S47T/Y92H/S166P/K206A/F217R/N247D/Q252H/M253F/A254E/A261G/H271A/Q302K/L316D/M322I/A337P/K362Q/E367N/R373K/M392T | 704 |
| 665 | + | + | + | R7C/L44R/S47T/Y92H/S166P/K206A/F217R/N247D/H271A/Q302K/L316D/M322I/A337P/K362Q/E367N/W368A/R373K/M392T | 705 |
| 666 | + | + | + | L44R/S47T/Y92H/S166P/K206A/F217R/P228L/N247D/H271A/Q302K/L316D/M322I/A337P/K362Q/E367N/R373K/M392T | 706 |
| 667 | + | + | + | D30G/L44R/S47T/Y92H/S166P/K206A/F217R/N247D/H271A/Q302K/L316D/M322I/A337P/K362Q/E367N/R373K/M392T | 707 |
| 668 | + | + | + | M39E/L44R/S47T/Y92H/S166P/K206A/F217R/N247D/H271A/Q302K/L316D/M322I/A337P/K362Q/E367N/R373K/M392T | 708 |
| 669 | + | − | − | L44R/S47T/Y92H/S166P/K206A/F217R/N247D/P262S/H271A/Q302K/L316D/M322I/A337P/K362Q/E367N/R373K/M392T | 709 |
| 670 | + | + | + | L44R/S47T/Y92H/S166P/K206A/F217R/N247D/H271A/Q302K/N305L/L316D/M322I/A337P/K362Q/E367N/R373K/M392T | 710 |
| 671 | ++ | ++ | + | T10P/L44R/S47T/Y92H/S166P/K206A/F217R/N247D/H271A/Q302K/L316D/M322I/A337P/K362Q/E367N/W368A/R373K/M392T | 711 |
| 672 | + | + | − | L44R/S47T/Y92H/D144Y/S166P/K206A/F217R/N247D/H271A/Q302K/L316D/M322I/A337P/K362Q/E367N/R373K/M392T | 712 |
| 673 | + | + | + | L44R/S47T/Y92H/S166P/K206A/F217R/N247D/H271A/Q302K/L316D/M322I/A337P/K362Q/E367N/R373K/N377Y/M392T | 713 |
| 674 | − | − | − | L44R/S47T/Y92H/S166P/K206A/F217R/P234H/N247D/H271A/Q302K/L316D/M322I/A337P/K362Q/E367N/R373K/M392T | 714 |
| 675 | + | + | + | L44R/S47T/M65V/Y92H/S166P/K206A/F217R/N247D/H271A/Q302K/L316D/M322I/A337P/K362Q/E367N/R373K/M392T | 715 |
| 676 | + | + | + | M39E/L44R/S47T/Y92H/S166P/K206A/F217R/N247D/H271A/Q302K/L316D/M322I/A337P/K362Q/E367N/W368A/R373K/M392T | 716 |
| 677 | + | + | − | L44R/S47T/Y92H/S166P/K206A/F217R/N247D/M253W/H271A/S273D/P274S/K277R/Q302K/L316D/M322I/A337P/K362Q/E367N/R373K/M392T | 717 |
| 678 | − | − | − | L44R/S47T/Y92H/S166P/K206A/F217R/N247D/M253W/A257G/H271A/K277R/Q281L/Q302K/L316D/A319D/M322I/A337P/K362Q/E367N/R373K/M392T | 718 |
| 679 | + | + | + | T10P/M39E/L44R/S47T/Y92H/S166P/K206A/F217R/N247D/H271A/Q302K/N305L/L316D/M322I/A337P/K362Q/E367N/R373K/M392T | 719 |
| 680 | + | + | + | T10P/M39E/L44R/S47T/Y92H/S166P/K206A/F217R/N247D/H271A/Q302K/L316D/M322I/A337P/K362Q/E367N/R373K/M392T | 720 |
| 681 | − | − | − | R7P/L44R/S47T/Y92H/S166P/K206A/F217R/N247D/H271A/Q302K/L316D/M322I/A337P/K362Q/E367N/R373K/M392T | 721 |

TABLE 2.9-continued

Relative Activity of GLA Variants After No Challenge (NC) or Challenge at the Indicated pH or Condition

| Variant # | pH NC | pH 3.5 | pH 7.5 | Amino acid differences relative to SEQ ID NO: 5 (WT GLA) | SEQ ID NO: |
|---|---|---|---|---|---|
| 682 | + | + | + | L44R/S47T/Y92H/S166P/K206A/F217R/N247D/H271A/Q302K/L316Y/M322I/A337P/K362Q/E367N/R373K/M392T | 722 |
| 683 | + | + | − | M39E/E43D/L44R/S47T/Y92H/S166P/K206A/F217R/W246P/N247D/M253W/H271A/S273D/Q302K/L316D/M322I/A337P/K362Q/E367N/W368A/R373K/M392T | 723 |
| 684 | + | + | + | L44R/S47T/Y92H/S166P/K206A/F217R/N247D/H271A/Q302K/N305L/L316D/M322I/A337P/K362Q/E367N/W368A/R373K/M392T | 724 |
| 685 | + | − | − | E43D/L44R/S47T/Y92H/S166P/K206A/F217R/N247D/M253W/A257G/H271A/Q302K/N305L/L316D/M322I/A337P/K362Q/E367N/W368A/R373K/M392T | 725 |
| 686 | − | − | + | T10P/E17G/L44R/S47T/Y92H/S166P/K206A/F217R/N247D/H271A/Q302K/L316D/M322I/A337P/K362Q/E367N/R373K/M392T | 726 |
| 687 | + | − | − | L44R/S47T/Y92H/S166P/K206A/F217R/N247D/H271A/Q290R/Q302K/L316D/M322I/A337P/K362Q/E367N/W368A/R373K/M392T | 727 |
| 688 | + | + | − | L44R/S47T/Y92H/S166P/K206A/F217R/P228Q/N247D/H271A/Q302K/L316D/M322I/A337P/K362Q/E367N/R373K/M392T | 728 |
| 689 | + | + | + | L44R/S47T/Y92H/S166P/K206A/F217R/N247D/H271A/Q302K/N305L/L316D/M322I/A337P/K362Q/E367N/R373K/M392T | 729 |
| 690 | + | − | − | T10P/L44R/S47T/Y92H/M156V/S166P/K206A/F217R/N247D/H271A/Q302K/L316D/M322I/A337P/K362Q/E367N/R373K/M392T | 730 |
| 691 | + | + | + | T10P/L44R/S47T/Y92H/S166P/K206A/F217R/N247D/H271A/Q302K/L316D/M322I/A337P/K362Q/E367N/R373K/M392T | 731 |
| 692 | − | − | − | L44R/S47T/Y92H/S166P/K206A/F217R/N247D/W256L/H271A/Q302K/L316D/M322I/A337P/K362Q/E367N/R373K/M392T | 732 |
| 693 | + | + | + | L44R/S47T/Y92H/S166P/K206A/F217R/N247D/H271A/Q302K/L316D/M322I/A337P/K362Q/E367N/W368A/R373K/M392T | 733 |

1. Relative activity was calculated as activity of the variant/activity of Rd7BB (SEQ ID NO: 44) (encoded by SEQ ID NO: 43).
2. − = <0.5 relative activity to Rd7BB (SEQ ID NO: 44); + = >0.5 to 1.5 relative activity over Rd7BB (SEQ ID NO: 44); and ++ = >1.5 relative activity over Rd7BB (SEQ ID NO: 44);

Example 3

In Vitro Characterization of GLA Variants

Production of GLA in Yeast

In order to produce GLA-containing supernatant, replica HTP-cultures of GLA were grown as described in Example 2. Supernatants from replica cultures (n=12-36) were combined prior to further analysis.

Production of GLA in HEK293T Cells

Secreted expression of GLA variants in mammalian cells was performed by transient transfection of HEK293 cells. Cells were transfected with GLA variants (SEQ ID NOS:3, 4, 9, 12, 17, 20, 23, and 41) fused to an N-terminal synthetic mammalian signal peptide and subcloned into the mammalian expression vector pLEV113 as described in Example 1. HEK293 cells were transfected with plasmid DNA and grown in suspension for 4 days using techniques known to those skilled in the art. Supernatants were collected and stored at 4° C.

Example 4

Purification of GLA Variants

Purification of GLA Variants from Mammalian Cell Supernatants

GLA variants were purified from mammalian culture supernatant essentially as known in the art (See, Yasuda et al., Prot. Exp. Pur. 37, 499-506 [2004]). Concanavalin A resin (Sigma Aldrich) was equilibrated with 0.1 M sodium acetate, 0.1 M NaCl, 1 mM $MgCl_2$, $CaCl_2$, and $MnCl_2$ pH 6.0 (Con A binding buffer). Supernatant was diluted 1:1 with binding buffer and loaded onto the column. The column was washed with 15 volumes of Concanavalin A binding buffer, and samples were eluted by the addition of Concanavalin A binding buffer including 0.9 M methyl-α-D-mannopyranoside and 0.9 M methyl-α-D-glucopyranoside. Eluted protein was concentrated and buffer exchanged three times using a Centricon® Plus-20 filtration unit with a 10 kDa molecular weight cut off (Millipore) into ThioGal binding buffer (25 mM citrate-phosphate, 0.1 M NaCl, pH 4.8). Buffer exchanged samples were loaded onto a Immobilized-D-galactose resin (Pierce) equilibrated with ThioGal binding buffer. The resin was washed with six volumes of ThioGal binding buffer and eluted with 25 mM citrate phosphate, 0.1 M NaCl, 0.1 M D-galactose, pH 5.5. Eluted samples were concentrated using a Centricon® Plus-20 filtration unit with a 10 kDa molecular weight cut off. Purification resulted in between 2.4-10 g of purified protein/ml of culture supernatant based on Bradford quantitation.

SDS-PAGE Analysis of GLA Variants

Samples of yeast culture supernatant and mammalian cell culture supernatant and purified GLA were analyzed by SDS-PAGE. In the yeast supernatants, GLA levels were too low to be detected via this method. Bands corresponding to the ~49 kDa predicted GLA molecular weight were found in both mammalian cell culture supernatants and purified GLA samples.

Immunoblot Analysis of GLA Variants

Samples of yeast supernatant and mammalian cell culture supernatant were analyzed by immunoblot. Briefly, samples were separated via SDS-PAGE. Protein was transferred to a PVDF membrane using an iBlot dry blot system (Life Technologies). The membrane was blocked with Odyssey blocking buffer (TBS) (LI-COR) for 1 h at RT and probed with a 1:250 dilution of rabbit α-GLA IgG (Thermo-Fischer) in Odyssey blocking buffer with 0.2% Tween® 20 for 14 h at 4° C. The membrane was washed 4×5 min with Tris-buffered saline+0.1% Tween® 20 and probed with a 1:5000 dilution of IRDye800CW donkey α-rabbit IgG (LI-COR) in Odyssey blocking buffer with 0.2% Tween® 20 and 0.01%

SDS for 1 hr at RT. The membrane was washed 4×5 min with Tris-buffered saline+0.1% Tween® 20, and analyzed using an Odyssey Imager (LI-COR). Bands corresponding to the ~49 kDa predicted GLA molecular weight were found in both the mammalian cell culture and yeast supernatants. In S. cerevisiae expressed samples, mutants containing the mutation E367N ran at a slightly higher MW. This mutation introduces a canonical NXT N-linked glycosylation site (where X is any amino acid except P) and the possible introduction of an additional N-linked glycan may account for the higher MW.

Example 5

In Vitro Characterization of GLA Variants

Optimization of Signal Peptide for Secreted Expression of GLA by S. cerevisiae

S. cerevisiae transformed with Mfleader-GLA (SEQ ID NO:7), SP-GLA (SEQ ID NO:36) or a vector control were grown in HTP as described in Example 2. Cultures were grown for 48-120 h prior to harvest of the supernatant and analysis (n=6) as described in Example 2. FIG. 1 provides a graph showing the relative activity of different GLA constructs in S. cerevisiae after 2-5 days of culturing. As indicated in this Figure, SP-GLA (SEQ ID NO:36) produced a high level of active enzyme that saturated after three days of growth.

pH Stability of GLA Variants Expressed in S. cerevisiae

Figure 2:
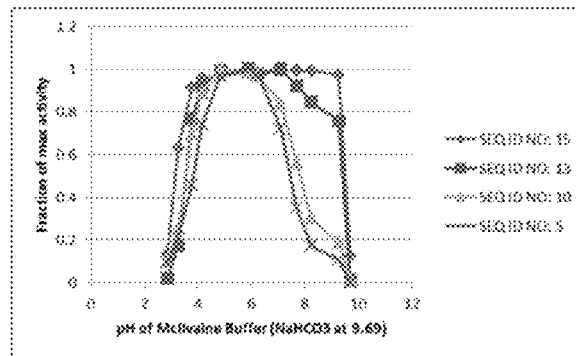
FIG. 2 provides graphs showing the Absolute (Panel A) and relative (Panel B) activity of GLA variants after incubation at various pHs.
Figure 2:
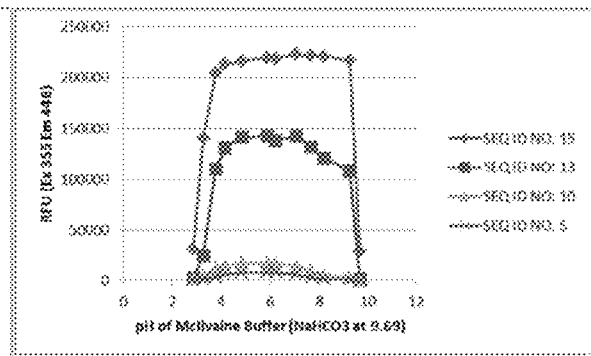

GLA variants were challenged with different buffers to assess the overall stability of the enzyme. First, 50 µL of supernatant from a GLA variant yeast culture and 50 uL of McIlvaine buffer (pH 2.86-9.27) or 200 mM sodium carbonate (pH 9.69) were added to the wells of a 96-well round bottom plate (Costar #3798, Corning). The plates were sealed and incubated at 37° C. for 1 h. For the assay, 50 µL of challenged supernatant was mixed with 25 µL of 1 M citrate buffer pH 4.3 and 25 µL of 4 mM MUGal in McIlvaine buffer pH 4.8. The reactions were mixed briefly and incubated at 37° C. for 60-180 minutes, prior to quenching with 100 µL of 1 M sodium carbonate. Hydrolysis was analyzed using a SpectraMax® M2 microplate reader monitoring fluorescence (Ex. 355 nm, Em. 448 nm). FIG. 2 provides graphs showing the absolute (Panel A) and relative (Panel B) activity of GLA variants after incubation at various pHs.

Thermostability of GLA Variants Expressed in S. cerevisiae

Figure 3:
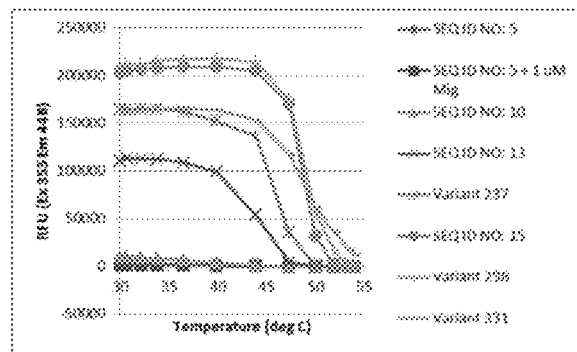
FIG. 3 provides graphs showing the absolute (Panel A) and relative (Panel B) activity of GLA variants after incubation at various temperatures.
Figure 3:
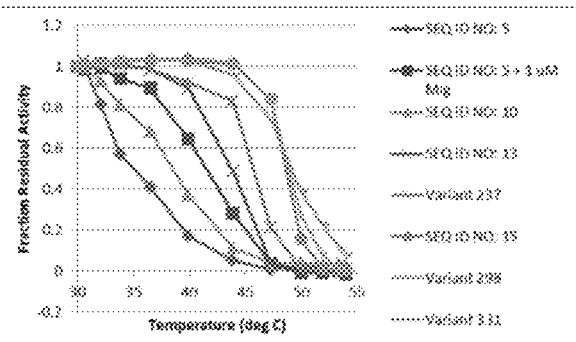

GLA variants were challenged at various temperatures in the presence and absence of 1 M 1-deoxygalactonojirimycin (Migalastat; Toronto Research Chemicals) to assess the overall stability of the enzyme. First, 50 µL of supernatant from a GLA variant yeast culture and 50 uL of McIlvaine buffer (pH 7.65)+/−2 mM 1-deoxygalactonojirimycin were added to the wells of a 96-well PCR plate (Biorad, HSP-9601). The plates were sealed and incubated at 30-54° C. for 1 h using the gradient program of a thermocycler. For the assay, 50 µL of challenged supernatant was mixed with 25 µL of 1 M citrate buffer pH 4.3 and 25 µL of 4 mM MUGal in McIlvaine buffer pH 4.8. The reactions were mixed briefly and incubated at 37° C. for 90 minutes, prior to quenching with 100 µL of 1 M sodium carbonate. Hydrolysis was analyzed using a SpectraMax® M2 microplate reader monitoring fluorescence (Ex. 355 nm, Em. 448 nm). FIG. 3 provides graphs showing the absolute (Panel A) and relative (Panel B) activity of GLA variants after incubation at various temperatures.

Serum Stability of GLA Variants Expressed in S. cerevisiae

Figure 4:
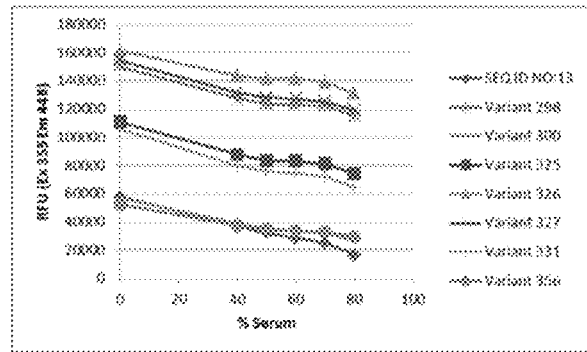
FIG. 4 provides graphs showing the absolute (Panel A&B) and relative (Panel C&D) activity of GLA variants after challenge with buffers that contain increasing amounts of serum.
Figure 4:
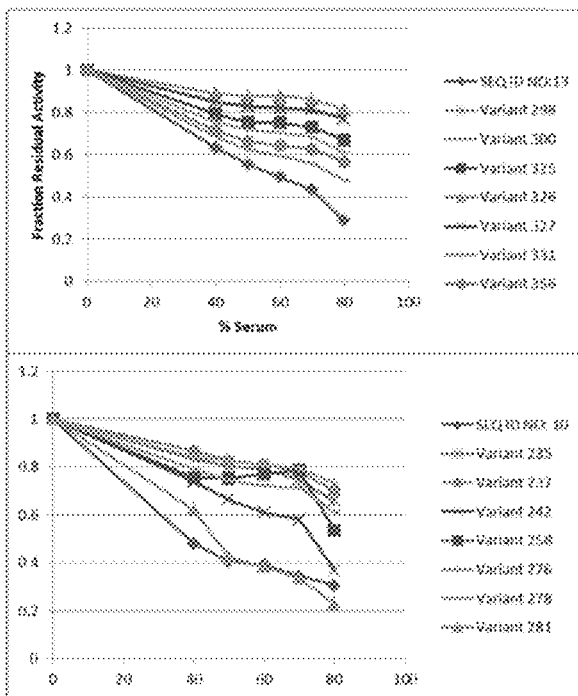

To assess the relative stability of variants in the presence of blood, samples were exposed to serum. First, 20 µL of supernatant from a GLA variant yeast culture and 0-80 µL of water and 0-80 L of bovine serum were added to the wells of a 96-well round bottom plate (Costar #3798, Corning). The plates were sealed and incubated at 37° C. for 1 h. For the assay, 50 µL of challenged supernatant was mixed with 25 µL of 1 M citrate buffer pH 4.3 and 25 µL of 4 mM MUGal in McIlvaine buffer pH 4.8. The reactions were mixed briefly and incubated at 37° C. for 90 minutes, prior to quenching with 100 µL of 1 M sodium carbonate. Hydrolysis was analyzed using a SpectraMax® M2 microplate reader monitoring fluorescence (Ex. 355 nm, Em. 448 nm). FIG. 4 provides graphs showing the absolute (Panels A and B) and relative (Panels C and D) activity of GLA variants after challenge with various percentages of serum.

Relative Activities of GLA Variants Expressed in HEK293T Cells

Figure 5:
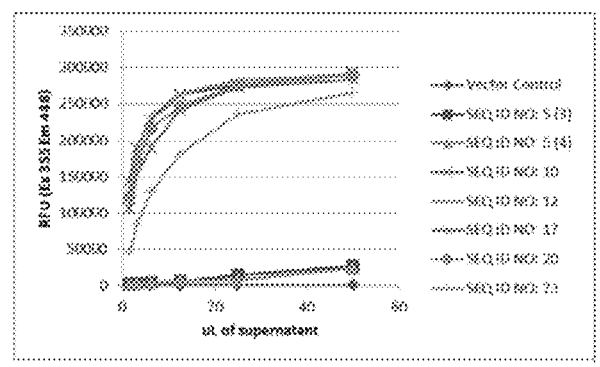
FIG. 5 provides a graph showing the relative activity of GLA variants expressed in HEK293T cells.

Supernatants from GLA variants expressed in HEKT293T cells were serially diluted 2× with supernatant from a non GLA expressing yeast culture. Dilutions (50 µL) were mixed with 25 µL of 4 mM MUGal in McIlvaine Buffer pH 4.8 and 25 µL of 1 M citrate buffer pH 4.3 in a Corning® 96-well, black, opaque bottom plate. The reactions were mixed briefly and incubated at 37° C. for 60 minutes, prior to quenching with 100 µL of 1 M sodium carbonate. Hydrolysis was analyzed using a SpectraMax® M2 microplate reader monitoring fluorescence (Ex. 355 nm, Em. 448 nm). FIG. 5 provides a graph showing the relative activity of GLA variants expressed in HEK293T cells. Supernatants from cells transfected with variant GLA enzymes showed markedly higher hydrolase activities compared to the WT enzymes, and much more activity per volume than was seen in S. cerevisiae expression.

pH Stability of GLA Variants Expressed in HEK293T Cells

Figure 6:
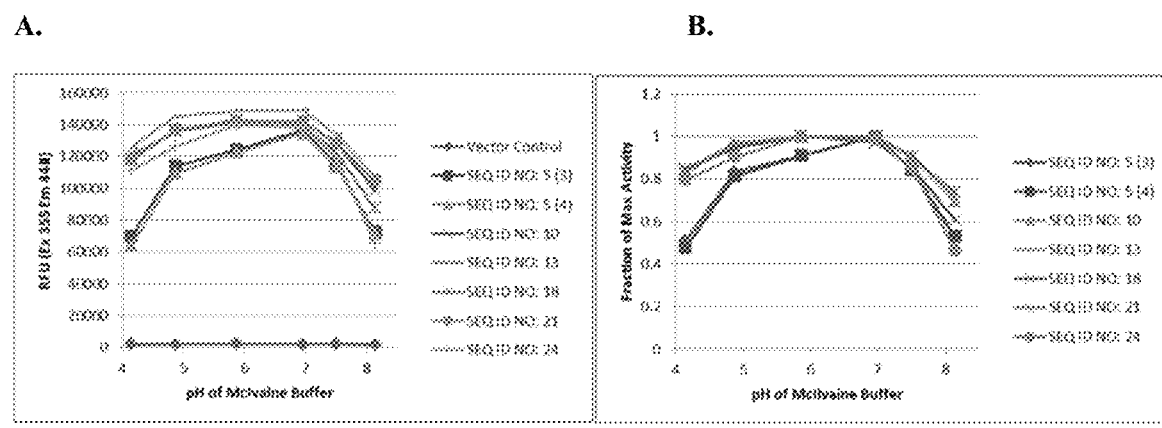
FIG. 6 provides graphs showing the absolute (Panel A) and relative (Panel B) activity of GLA variants expressed in HEK293T cells, normalized for activity, and incubated at various pHs.

GLA variants were challenged with different buffers to assess their overall stability. Supernatants from mammalian cell cultures were normalized to equal activities by dilution with supernatant from a non GLA expressing culture. Normalized supernatants (50 µL) and 50 uL of McIlvaine buffer (pH 4.06-8.14) were added to the wells of a 96-well round bottom plate (Costar #3798, Corning). The plates were sealed and incubated at 37° C. for 3 h. For the assay, 50 µL of challenged supernatant was mixed with 25 µL of 1 M citrate buffer pH 4.3 and 25 µL of 4 mM MUGal in McIlvaine buffer pH 4.8. The reactions were mixed briefly and incubated at 37° C. for 3 h, prior to quenching with 100 µL of 1 M sodium carbonate. Hydrolysis was analyzed using a SpectraMax® M2 microplate reader monitoring fluorescence (Ex. 355 nm, Em. 448 nm). FIG. 6 provides graphs showing the absolute (Panel A) and relative (Panel B) activity of GLA variants expressed in HEK293T cells, normalized for activity, and incubated at various pHs.

All enzymes were found to be more stable versus pH challenges when compared to WT GLA expressed in S. cerevisiae (compare with FIG. 2). This difference is possibly due to differential glycosylation between expression hosts. However, it is not intended that the present invention be limited to any particular mechanism or theory. Mutant enzymes had broader pH stability profiles compared to the WT enzyme expressed in HEK293T.

Thermostability of GLA Variants Expressed in HEK293T Cells

Figure 7:
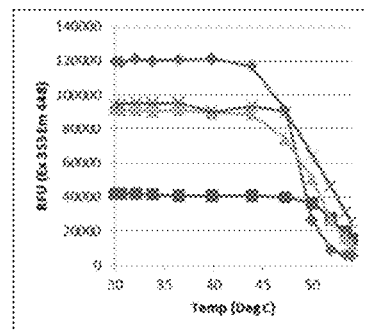
FIG. 7 provides graphs showing the absolute (Panel A) and relative (Panel B) activity of GLA variants expressed in HEK293T cells, normalized for activity, and incubated at various temperatures.
Figure 7:
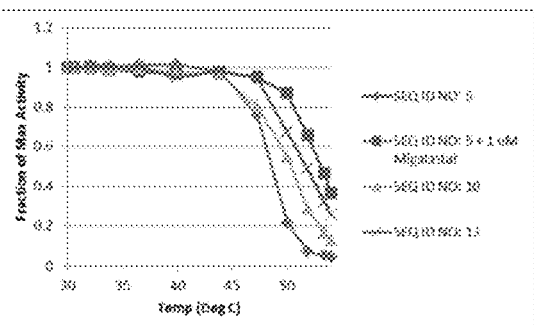

GLA variants were challenged at various temperatures in the presence and absence of 1 M 1-deoxygalactonojirimycin (Migalastat) to assess their overall stability. Supernatants from mammalian cell cultures were normalized to approximately equal activities by dilution with supernatant from a non GLA expressing culture. Diluted supernatants were added to the wells of a 96-well PCR plate (Biorad, HSP-9601). The plates were sealed and incubated at 30-54° C. for 1 h using the gradient program of a thermocycler. For the assay, 20 µL of challenged supernatant was mixed with 30 µL of 1 M citrate buffer pH 4.3 and 50 µL of 4 mM MUGal in McIlvaine buffer pH 4.8. The reactions were mixed briefly and incubated at 37° C. for 90 minutes, prior to quenching with 100 µL of 1 M sodium carbonate. Hydrolysis was analyzed using a SpectraMax® M2 microplate reader monitoring fluorescence (Ex. 355 nm, Em. 448 nm). FIG. 7 provides graphs showing the absolute (Panel A) and relative (Panel B) activity of GLA variants expressed in HEK293T cells, normalized for activity, and incubated at various temperatures. As shown in this Figure, all of the enzymes were more stable after temperature challenges when compared to WT GLA expressed in *S. cerevisiae* (compare with FIG. 2), likely due to differential glycosylation between expression hosts. In the GLA variants (SEQ ID NOS:10 and 13) the $T_m$ of the enzyme was increased by 2 and 4° C. respectively. Addition of Migalastat increased the $T_m$ by 5.5° C., however at a 0.2 M final concentration in the assay, activity in the Migalastat treated sample was reduced by ~60%.

Activity of WT GLA and GLA Variants on an Alternative Substrate

To confirm that improved activity in MUGal hydrolysis corresponded to more native substrates, mammalian cell-expressed GLA variants were assayed using N-Dodecanoyl-NBD-ceramide trihexoside (NBD-GB3) as substrate. HEK293T culture supernatant (10 µL), 100 mM sodium citrate pH 4.8 (80 µL), and NBD-GB3 (0.1 mg/ml) in 10% ethanol (10 µL) were added to microcentrifuge tubes. Samples were inverted to mix, and incubated at 37° C. for 1 h. The reaction was quenched via addition of 50 µL methanol, diluted with 100 µL chloroform, vortexed and the organic layer was isolated for analysis. The organic phase (10 µL) was spotted onto a silica plate and analyzed by thin layer chromatography (chloroform:methanol:water, 100:42: 6), detecting the starting material and product using a 365 nm UV lamp. Significant conversion was observed only with SEQ ID NO:13, confirming that the variant exhibits improved activity, as compared to the WT GLA.

Specific Activity of GLA Variants

GLA variants purified as described in Example 4, were evaluated for their specific activity. Between 0-0.25 ng of purified enzyme was added to 4 mM MUGal in McIlvaine buffer pH 4.8 (final pH of 4.8). Samples were incubated for 60 min at 37° C. and quenched via addition of 100 µL of 1 M sodium carbonate. Hydrolysis was analyzed using a SpectraMax® M2 microplate reader monitoring fluorescence (Ex. 355 nm, Em. 448 nm), and correlated to absolute amounts of 4-methylumbelliferone through the use of a standard curve.

pH Stability of Purified GLA Variants Over Time

Figure 8:
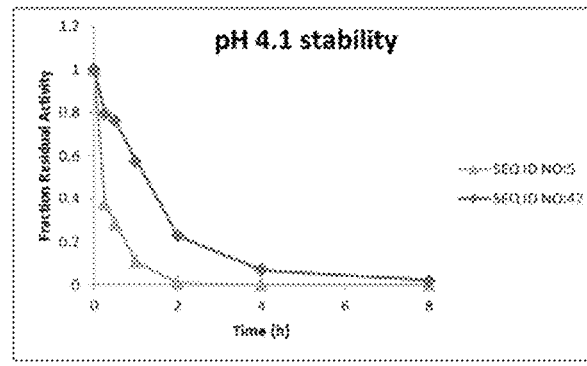
FIG. 8 provides graphs showing GLA variant activity remaining after incubation in acidic (Panel A) or basic (Panel B) solutions.
Figure 8:
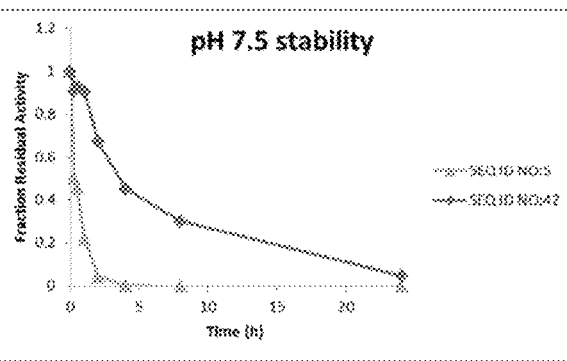

To confirm that purified GLA variants show the desired pH stability observed after expression in yeast, WT GLA (SEQ ID NO:5) and SEQ ID NO:42 were incubated in acidic or basic buffers and analyzed for residual activity. GLA variants (200 ng) were added to McIlvaine buffer pH 4.1 or 7.5 and incubated for 0-24 h at 37° C. Samples (50 µL) were added to a mixture of 25 uL 1M citric acid pH 4.3 and 25 µL of 4 mM MUGal in McIlvaine buffer pH 4.8, and incubated at 37° C. for 1 h. Samples were quenched with 100 µL of 1 M sodium carbonate, diluted 1:4 in 1 M sodium carbonate and analyzed by fluorescence spectroscopy (Ex. 355, Em. 448). SEQ ID NO:42 was considerably more stable under both acidic and basic challenge conditions confirming that stability advances developed in yeast translated to the protein expressed in mammalian cells (See FIG. 8 for graphs of the results).

Thermostability of Purified GLA Variants Expressed in HEK293T Cells

The thermostability of WT GLA (SEQ ID NO:5) and SEQ ID NO:42 were determined to assess their overall stability. Purified enzyme as described in Example 4 was diluted to 20 µg/ml in 1×PBS with 1× Sypro Orange (Thermo Fischer Scientific), and added to a 96-well PCR plate (Biorad, HSP-9601). The plates were heated from 30 to 75° C. at 0.5° C./min on a RT-PCR machine and Sypro Orange fluorescence was monitored. Under these conditions WT GLA melted at 37° C., while SEQ ID NO:42 melted at 55° C.

Example 6

In Vivo Characterization of GLA Variants

Serum Pharmacokinetics of Purified GLA Variants

Figure 9:
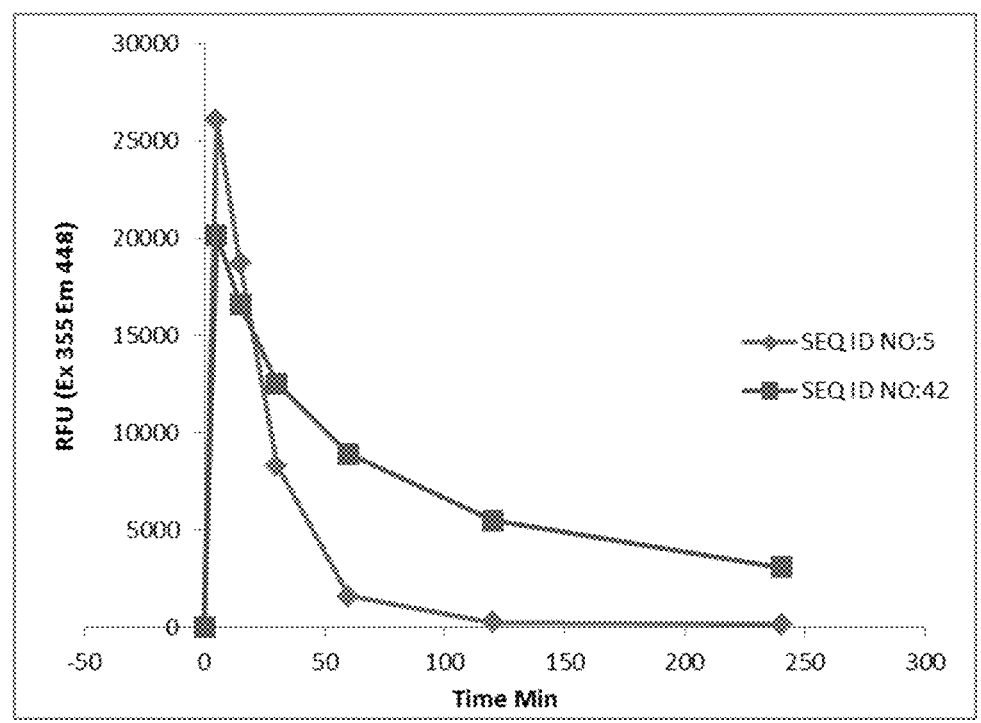
FIG. 9 provides a graph showing the GLA activity recovered in rat serum following administration of GLA variants.

Purified GLA variants produced as described in Example 4 were assessed for stability in the serum of live rats. WT GLA (SEQ ID NO:5) or SEQ ID NO:42 at 1 mg/ml were administered intravenously at 1 ml/kg to three naïve jugular vein cannulated Sprague-Dawley rats (7-8 weeks old) each. Prior to administration and at 5, 15, 30, 60, 120, and 240 minutes post-administration, 200 µL of blood was collected from each rat in an EDTA tube and centrifuged at 4° C. and 6000 rpm to generate >80 µL of serum per sample. Samples were frozen and stored on dry ice prior to analysis. For analysis, serum (10 µL) was added to 40 µL of 5 mM MUGal in McIlvaine buffer pH 4.4, and incubated at 37° C. for 1 h. Samples were quenched with 50 µL of 1 M sodium carbonate, diluted 1:100 in 1 M sodium carbonate and analyzed by fluorescence spectroscopy (Ex. 355, Em. 448). Four hours post-administration SEQ ID NO:42 retained 15.3% of maximal activity, while WT GLA retained only 0.66% (See, FIG. 9).

Example 7

Deimmunization of GLA

In this Example, experiments conducted to identify diversity that would remove predicted T-cell epitopes from GLA are described.

Identification of Deimmunizing Diversity:

To identify mutational diversity that would remove T-cell epitopes, computational methods were used to identify GLA subsequences that were predicted to bind efficiently to representative HLA receptors. In addition, experimental searches for amino acid mutations were conducted, particularly for mutations that do not affect GLA activity (e.g., in the assays described in Example 2). The amino acid sequences of active variants were then analyzed for predicted immunogenicity using computational methods.

Computational Identification of Putative T-Cell Epitopes in a WT GLA:

Putative T-cell epitopes in a WT GLA (SEQ ID NO:5) were identified using the Immune Epitope Database (IEDB; Immune Epitope Database and Analysis Resource website) tools, as known in the art and proprietary statistical analysis tools (See e.g., iedb.org and Vita et al., Nucl. Acids Res., 38(Database issue):D854-62 [2010]. Epub 2009 Nov. 11]). The WT GLA was parsed into all possible 15-mer analysis frames, with each frame overlapping the last by 14 amino acids. The 15-mer analysis frames were evaluated for immunogenic potential by scoring their 9-mer core regions for predicted binding to eight common class II HLA-DR alleles (DRB1*0101, DRB1*0301, DRB1*0401, DRB1*0701, DRB1*0801, DRB1*1101, DRB1*1301, and DRB1*1501) that collectively cover nearly 95% of the human population (See e.g., Southwood et al., J. Immunol., 160:3363-3373 [1998]), using methods recommended on the IEDB website. Potential T-cell epitope clusters contained within the enzyme (i.e., sub-regions contained within GLA which have an unusually high potential for immunogenicity) were identified using statistical analysis tools, as known in the art. The identified T-cell epitope clusters were screened against the IEDB database of known epitopes. These screens identified five putative T-cell epitopes in the WT enzyme. These epitopes are referred to as TCE-I, II, III, IV, and V below.

Design of Deimmunizing Libraries:

First, the sequences of active GLA mutants identified in Example 2 are assessed for the presence of T-cell epitopes. Mutations identified to potentially reduce binding to the HLA-DR alleles are incorporated into a recombination library. Additional libraries are prepared using saturation mutagenesis of every single amino acid within the five T-cell epitopes. Hits from these libraries are subjected to further rounds of saturation mutagenesis, HTP screening, and recombination to remove all possible T-cell epitopes.

Construction and Screening of Deimmunizing Libraries:

Combinatorial and saturation mutagenesis libraries designed as described above were constructed by methods known in the art, and tested for activity in an unchallenged assay as described in Example 2. Active variants were identified and sequenced. Their activities and mutations with respect to WT GLA are provided in the table below.

Identification of Deimmunizing Diversity:

Active variants were analyzed for their levels of predicted immunogenicity by evaluating their binding to the eight common Class II HLA-DR alleles as described above. The total immunogenicity score and immunogenic hit count are shown in Table 7.1. The total immunogenicity score (TIS) reflects the overall predicted immunogenicity of the variant (i.e., a higher score indicates a higher level of predicted immunogenicity). The immunogenic "hit count" (IHC) indicates the number of 15-mer analysis frames with an unusually high potential for immunogenicity (i.e., a higher score indicates a higher potential for immunogenicity). Mutations resulting in a lower total immunogenicity score and/or an immunogenic hit count less than that of the reference sequence were considered to be potential "deimmunizing mutations". A collection of the most deimmunizing mutations were recombined to generate a number of variants that were active and predicted to be significantly less immunogenic than WT GLA. In the following Table, total immunogenicity score (TIS) and immunogenic hit count (IHC) are provided.

TABLE 7.1

Total Immunogenicity Score (TIS), and Immunogenic Hit Count (IHC) for GLA Variants

| Variant # | SEQ ID NO: | Active Mutations | TIS | IHC |
|---|---|---|---|---|
|  | 5 | WT GLA | 450 | 38 |
| 33 | 79 | A199H/E367S | 468 | 47 |
| 34 | 80 | A337P | 444 | 38 |
| 1 | 47 | A337S | 449 | 38 |
| 35 | 81 | A339S | 450 | 38 |
| 36 | 82 | A350G | 450 | 38 |
| 296 | 337 | A66T/K206A/F217R/L316D/M322I/A337P/K343G/A350G/E367N/R373K | 429 | 38 |
| 200 | 244 | C143A/K206A | 429 | 38 |
| 201 | 245 | C143T/K206A | 429 | 38 |
| 202 | 246 | C59A/K206A | 427 | 38 |
| 37 | 83 | D105A | 458 | 38 |
| 38 | 84 | D105S | 462 | 38 |
| 39 | 85 | D124N/E147G/N161K/R162Q/T163V/R165A/I167S/V168I/Y169V/S170-/M177S/F217E | 425 | 35 |
| 516 | 557 | D2E/L44R/Y92H/K206A/F217R/N247D/Q302K/L316D/M322I/Q326G/A337P/K362Q/E367N/R373K | 386 | 24 |
| 517 | 558 | D2Q/L44R/Y92H/K206A/F217R/N247D/Q302K/L316D/M322I/A337P/K362Q/E367N/R373K | 393 | 24 |
| 667 | 707 | D30G/L44R/S47T/Y92H/S166P/K206A/F217R/N247D/H271A/Q302K/L316D/M322I/A337P/K362Q/E367N/R373K/M392T | 345 | 8 |
| 40 | 86 | D396R | 451 | 38 |
| 41 | 87 | D396T | 452 | 38 |
| 42 | 88 | E367N | 462 | 43 |
| 43 | 89 | E367T | 462 | 45 |
| 44 | 90 | E387K | 460 | 38 |
| 45 | 91 | E387Q | 457 | 38 |
| 46 | 92 | E387R | 457 | 38 |
| 47 | 93 | E387T | 459 | 38 |
| 48 | 94 | E40D | 445 | 33 |
| 518 | 560 | E40D/L44R/Y92H/K206A/F217R/N247D/Q302K/L316D/M322I/A337P/K362Q/E367N/R373K | 390 | 24 |
| 519 | 561 | E40S/L44R/Y92H/K206A/F217R/N247D/Q302K/L316D/M322I/A337P/K362Q/E367N/R373K | 407 | 25 |
| 2 | 48 | E43D | 450 | 37 |
| 3 | 49 | E43D/E48D | 449 | 37 |
| 4 | 50 | E43D/E48D/I208V/N247D/Q299R/Q302K/R373K/I376V | 434 | 36 |
| 5 | 51 | E43D/E48D/I208V/R373K | 429 | 36 |
| 6 | 52 | E43D/E48D/I208V/R373K/I376V | 428 | 36 |
| 7 | 53 | E43D/E48D/N247D/Q299R/Q302K/R373K/I376V | 448 | 36 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 8 | 54 | E43D/E48D/N247D/Q302K/R373K | 442 | 36 |
| 9 | 55 | E43D/E48D/Q302K/R373K/I376V | 442 | 36 |
| 10 | 56 | E43D/I208V/N247D | 435 | 37 |
| 11 | 57 | E43D/I208V/N247D/Q299R/R373K/I376V | 435 | 36 |
| 12 | 58 | E43D/I208V/Q299R/R373K/I376V | 436 | 36 |
| 663 | 703 | E43D/L44R/S47T/Y92H/S166P/K206A/F217R/N247D/A261G/H271A/Q302K/L316D/M322I/A337P/K362Q/E367N/W368A/R373K/M392T | 315 | 1 |
| 685 | 725 | E43D/L44R/S47T/Y92H/S166P/K206A/F217R/N247D/M253W/A257G/H271A/Q302K/N305L/L316D/M322I/A337P/K362Q/E367N/W368A/R373K/M392T | 334 | 7 |
| 634 | 674 | E43D/L44R/Y92E/S166P/K206A/F217R/N247D/Q302K/L316D/M322I/A337P/K362Q/E367N/R373K | 362 | 21 |
| 635 | 375 | E43D/L44R/Y92H/S166P/K206A/F217R/N247D/Q302K/L316D/M322I/A337P/K362Q/E367N/R373K | 378 | 21 |
| 636 | 376 | E43D/L44R/Y92N/S166P/K206A/F217R/N247D/Q302K/L316D/M322I/A337P/K362Q/E367N/R373K | 366 | 21 |
| 633 | 673 | E43D/L44R/Y92S/S166P/K206A/F217R/N247D/Q302K/L316D/M322I/A337P/K362Q/E367N/R373K | 365 | 21 |
| 13 | 59 | E43D/N247D/R373K/I376V | 442 | 36 |
| 14 | 60 | E43D/R373K/I376V | 443 | 36 |
| 637 | 377 | E43Q/L44R/Y92E/S166P/K206A/F217R/N247D/Q302K/L316D/M322I/A337P/K362Q/E367N/R373K | 370 | 21 |
| 15 | 61 | E48D/I208V/Q299R/Q302K/R373K | 437 | 37 |
| 16 | 62 | E48D/R373K/I376V | 443 | 37 |
| 17 | 63 | E48G/R373K | 444 | 37 |
| 49 | 95 | F180R | 454 | 38 |
| 50 | 96 | F180S | 449 | 38 |
| 51 | 97 | F198S | 450 | 38 |
| 52 | 98 | F217D | 450 | 38 |
| 53 | 99 | F217R | 450 | 38 |
| 18 | 64 | F217S | 452 | 38 |
| 54 | 100 | F352I | 450 | 38 |
| 55 | 101 | F352V/F365I | 447 | 38 |
| 56 | 102 | F365I | 447 | 38 |
| 57 | 103 | F365K | 446 | 38 |
| 58 | 104 | F365E | 448 | 38 |
| 59 | 105 | F365R | 447 | 38 |
| 60 | 106 | F365T | 436 | 38 |
| 61 | 107 | F365V | 447 | 38 |
| 62 | 108 | G303Q/R373V | 465 | 38 |
| 63 | 109 | H155A | 451 | 38 |
| 64 | 110 | H155E | 455 | 41 |
| 65 | 111 | H155R | 452 | 39 |
| 66 | 112 | H155T | 449 | 38 |
| 213 | 255 | H15Q/K206A | 429 | 38 |
| 67 | 113 | H375E | 437 | 36 |
| 68 | 114 | H84S | 450 | 38 |
| 69 | 115 | I102L | 450 | 38 |
| 70 | 116 | I102L/L394V | 449 | 37 |
| 71 | 117 | I123T/T369N | 449 | 38 |
| 72 | 118 | I167V | 438 | 37 |
| 19 | 65 | I208V/N247D/Q299R/Q302K/R373K/I376V | 435 | 37 |
| 20 | 66 | I208V/N247D/Q299R/R373K/I376V | 435 | 37 |
| 21 | 67 | I208V/N247D/R373K/I376V | 428 | 37 |
| 22 | 68 | I208V/Q299R/I376V | 436 | 37 |
| 23 | 69 | I208V/Q302K/R373K/I376V | 429 | 37 |
| 24 | 70 | I376V | 443 | 37 |
| 73 | 10 | K206A | 429 | 38 |
| 196 | 240 | K206A/A350G | 429 | 38 |
| 197 | 241 | K206A/A350G/K362Q/T369A | 413 | 38 |
| 198 | 242 | K206A/A350G/T369D | 426 | 38 |
| 199 | 243 | K206A/A350G/T369S | 429 | 38 |
| 203 | 247 | K206A/E367A/T369D | 439 | 42 |
| 204 | 248 | K206A/E367D | 427 | 38 |
| 205 | 21 | K206A/E367D/T369D | 419 | 37 |
| 206 | 18 | K206A/E367N | 441 | 43 |
| 207 | 249 | K206A/E367N/R373K | 430 | 38 |
| 208 | 250 | K206A/E367N/R373K/I376V | 429 | 38 |
| 209 | 251 | K206A/E367P/T369D | 430 | 38 |
| 297 | 338 | K206A/F217R/G230V/N247D/Q302K/M322I/E367N/T369S/R373K | 453 | 42 |
| 233 | 274 | K206A/F217R/N247D/L316D/A350G/E367D/T369D | 416 | 37 |
| 298 | 339 | K206A/F217R/N247D/L316D/M322I/A337P/A350G/K362Q/E367N/R373K | 420 | 37 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 299 | 340 | K206A/F217R/N247D/Q249H/Q302K/M322I/K343G/A350G/E367T/R373K/L397F | 434 | 40 |
| 234 | 275 | K206A/F217R/N247D/Q302K/A350G/E367D/T369D | 418 | 37 |
| 235 | 276 | K206A/F217R/N247D/Q302K/L316D/A337P/A350G/E367D/T369D | 410 | 37 |
| 236 | 277 | K206A/F217R/Q302K/E367D/T369D | 419 | 37 |
| 237 | 278 | K206A/F217R/Q302K/L316D/A337P/A350G/E367D/T369D | 411 | 37 |
| 210 | 252 | K206A/F365L/E367N | 439 | 41 |
| 211 | 253 | K206A/F365L/E367N/I376V | 435 | 40 |
| 212 | 254 | K206A/F365L/E367N/R373K/I376V | 435 | 40 |
| 238 | 279 | K206A/I208V/M322V/K343G/F365L/R373K/I376V | 415 | 37 |
| 239 | 280 | K206A/I208V/R221K/N247D/M322I/K343D/F365L/R373K/I376V | 425 | 37 |
| 300 | 341 | K206A/I208V/R221T/N247D/M322V/K343G/E367N/R373K | 424 | 38 |
| 214 | 256 | K206A/K343D/F365L/E367N | 433 | 41 |
| 215 | 257 | K206A/K343G | 424 | 38 |
| 216 | 258 | K206A/K343G/F365L/E367N/R373K | 431 | 40 |
| 240 | 281 | K206A/L269I/P349L/R373K | 428 | 42 |
| 217 | 289 | K206A/L316D | 427 | 38 |
| 218 | 13 | K206A/M322I/E367N/R373K | 442 | 38 |
| 301 | 342 | K206A/M322I/E367N/R373K | 442 | 38 |
| 219 | 260 | K206A/M322I/R373K | 435 | 37 |
| 302 | 343 | K206A/M322V/K343G/E367N/R373K | 425 | 38 |
| 220 | 261 | K206A/M322V/R373K/I376V | 422 | 37 |
| 221 | 262 | K206A/M390I | 414 | 33 |
| 303 | 344 | K206A/N247D/M322I/A337E/K343D/F365L/E367N/R373K/I376V | 440 | 40 |
| 241 | 282 | K206A/N247D/M322V/K343D/R373K/I376V | 415 | 37 |
| 242 | 283 | K206A/N247D/M322V/K343G/F365L/R373K | 415 | 37 |
| 243 | 284 | K206A/N247D/Q302K/A337P/K343G/A350G | 417 | 38 |
| 244 | 285 | K206A/N247D/Q302K/L316D/A350G | 426 | 38 |
| 245 | 286 | K206A/N247D/Q302K/M322V/F365L/R373K/I376V | 419 | 37 |
| 222 | 263 | K206A/P228Q/T369D | 426 | 38 |
| 223 | 264 | K206A/Q302K/A337P/A350G/K362Q | 408 | 38 |
| 246 | 287 | K206A/Q302K/L316D/A337P | 421 | 38 |
| 304 | 345 | K206A/Q302K/L316D/M322I/A337P/A350G/K362Q/E367N/T369S/R373K | 431 | 42 |
| 305 | 346 | K206A/Q302K/L316D/M322I/A337P/K343D/E367N/T369S/R373K | 438 | 42 |
| 224 | 265 | K206A/Q302K/M322V/E367N | 441 | 43 |
| 247 | 288 | K206A/R221K/N247D/M322V/K343D/R373K | 416 | 37 |
| 306 | 347 | K206A/R221K/N247D/Q302K/M322I/E367N/R373K | 441 | 38 |
| 307 | 348 | K206A/R221K/Q302K/M322I/K343G/E367N/R373K/I376V | 436 | 38 |
| 226 | 267 | K206A/R221T/F365L | 427 | 38 |
| 248 | 289 | K206A/R221T/M322V/K343G/R373K | 418 | 37 |
| 249 | 290 | K206A/R221T/M322V/R373K | 423 | 37 |
| 227 | 268 | K206A/R325H | 429 | 38 |
| 228 | 269 | K206A/R373K | 423 | 37 |
| 229 | 270 | K206A/R373K/I376V | 422 | 37 |
| 230 | 271 | K206A/S374R | 433 | 40 |
| 231 | 272 | K206A/T369D | 426 | 38 |
| 232 | 273 | K206A/T369S | 429 | 38 |
| 192 | 236 | K206E | 429 | 38 |
| 193 | 237 | K206G | 429 | 38 |
| 74 | 119 | K206M | 458 | 44 |
| 75 | 120 | K206Q | 450 | 38 |
| 76 | 24 | K206R | 450 | 38 |
| 194 | 238 | K206R | 450 | 38 |
| 195 | 239 | K206S | 429 | 38 |
| 77 | 121 | K206T/V359S | 437 | 44 |
| 78 | 122 | K343D | 444 | 38 |
| 79 | 123 | K343G | 445 | 38 |
| 80 | 124 | K362Q | 435 | 38 |
| 81 | 125 | K362R | 449 | 38 |
| 82 | 126 | K36D | 452 | 38 |
| 83 | 127 | K36E | 450 | 38 |
| 25 | 71 | K36Q | 450 | 38 |
| 84 | 128 | K395* | 432 | 34 |
| 85 | 129 | K395G | 448 | 37 |
| 86 | 130 | K395P | 448 | 37 |
| 87 | 131 | K395R | 451 | 38 |
| 88 | 132 | K395S | 450 | 38 |
| 89 | 133 | K395T | 448 | 37 |
| 90 | 134 | K96I | 433 | 36 |
| 250 | 291 | K96I/K206A/F217R | 412 | 36 |
| 308 | 349 | K96I/K206A/F217R/M322I/E367N/T369S/R373K | 434 | 40 |
| 251 | 292 | K96I/K206A/F217R/N247D | 411 | 36 |
| 252 | 293 | K96I/K206A/F217R/N247D/A350G/E367D/T369D | 401 | 35 |
| 253 | 294 | K96I/K206A/F217R/N247D/Q302K/E316D/A337P/E367D/T369D | 393 | 35 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 309 | 350 | K96I/K206A/F217R/N247D/Q302K/M322I/A337P/K343G/A350G/E367N/R373K | 413 | 36 |
| 310 | 351 | K96I/K206A/N247D/M322I/A350G/E367N/T369S/R373K | 433 | 40 |
| 311 | 352 | K96I/K206A/N247D/Q302K/E316D/M322I/A337P/A350G/E367N/T369S/R373K | 425 | 40 |
| 312 | 353 | K96I/K206A/N247D/Q302K/E316D/M322I/A337P/A350G/K362Q/E367N/T369S/R373K | 413 | 40 |
| 91 | 135 | K96E | 434 | 36 |
| 92 | 136 | K96R | 443 | 37 |
| 93 | 137 | K96R/E397V | 442 | 36 |
| 94 | 138 | E100F | 442 | 38 |
| 313 | 354 | L100F/A125S/K206A/I208V/R221K/Q302K/M322I/K343G/E367N/R373K | 429 | 38 |
| 254 | 295 | L100F/K206A | 421 | 38 |
| 314 | 355 | L100F/K206A/I208V/N247D/Q302K/M322V/K343D/E367N/R373K/I376V | 414 | 38 |
| 315 | 356 | L100F/K206A/I208V/Q302K/M322V/F365L/E367N/R373K/I376V | 427 | 40 |
| 316 | 357 | L100F/K206A/I208V/R221K/M322V/K343D/E367N/R373K | 416 | 38 |
| 317 | 358 | L100F/K206A/I208V/R221K/M322V/K343D/F365L/E367N/R373K | 422 | 40 |
| 255 | 296 | L100F/K206A/I208V/R221K/N247D/Q302K/M322I/K343D/F365L/I376V | 417 | 37 |
| 256 | 297 | L100F/K206A/I208V/R221K/N247D/Q302K/M322V/K343D/F365L/I376V | 405 | 37 |
| 318 | 359 | L100F/K206A/I208V/R221T/M322V/E367N/R373K/I376V | 421 | 38 |
| 257 | 298 | L100F/K206A/I208V/R221T/N247D/K343D/F365L/I376V | 405 | 37 |
| 258 | 299 | L100F/K206A/I208V/R221T/Q302K/M322I/K343D/I376V | 420 | 37 |
| 319 | 360 | L100F/K206A/M322I/E367N/R373K/I376V | 433 | 38 |
| 259 | 300 | L100F/K206A/M322V/F365L/R373K/I376V | 412 | 37 |
| 260 | 301 | L100F/K206A/N247D/F365L/R373K/I376V | 411 | 37 |
| 261 | 302 | L100F/K206A/N247D/M322V/K343D/I376V | 407 | 37 |
| 320 | 361 | L100F/K206A/N247D/Q302K/M322I/E367N/R373K | 433 | 38 |
| 321 | 362 | L100F/K206A/R221K/N247D/M322I/K343G/E367N/R373K | 428 | 38 |
| 262 | 303 | L100F/K206A/R221K/N247D/Q302K/M322V/F365L/R373K/I376V | 411 | 37 |
| 263 | 304 | L100F/K206A/R221K/N247D/Q302K/M322V/I376V | 413 | 37 |
| 264 | 305 | L100F/K206A/R221K/N247D/Q302K/M322V/K343D/R373K/I376V | 407 | 37 |
| 265 | 306 | L100F/K206A/R221K/R373K/I376V | 414 | 37 |
| 266 | 307 | L100F/K206A/R221T/M322I/K343E/F365L/R373K | 419 | 37 |
| 267 | 308 | L100F/K206A/R221T/N247D/Q302K/K343D/F365L/R373K | 406 | 37 |
| 322 | 363 | L100F/K206A/R221T/Q302K/M322I/K343D/E367N/R373K | 428 | 38 |
| 268 | 309 | L100F/K206A/R373K/I376V | 414 | 37 |
| 323 | 364 | L100F/L160I/K206A/R221K/M322V/E367N/R373K | 424 | 42 |
| 647 | 387 | L14F/L44R/S47T/Y92H/S166P/K206A/F217R/N247D/H271A/Q302K/L316D/M322I/A337P/K362Q/E367N/R373K/M392T | 345 | 8 |
| 95 | 139 | L158A | 437 | 35 |
| 96 | 140 | L158I | 458 | 42 |
| 97 | 141 | L158M | 450 | 40 |
| 98 | 142 | L158R | 431 | 35 |
| 99 | 143 | L23M | 450 | 38 |
| 324 | 365 | L23S/K206A/M322I/E367N/R373K | 442 | 38 |
| 100 | 144 | L23T | 450 | 38 |
| 101 | 145 | L316D | 448 | 38 |
| 102 | 146 | L316E | 448 | 38 |
| 269 | 310 | L37I/K206A/R221K/N247D/M322I/R373K | 434 | 37 |
| 103 | 147 | L384F | 448 | 35 |
| 104 | 148 | L386V | 436 | 31 |
| 105 | 149 | L394A | 449 | 37 |
| 106 | 150 | L394R | 450 | 38 |
| 107 | 151 | L394S | 450 | 38 |
| 108 | 152 | L394T | 449 | 37 |
| 109 | 153 | L397* | 442 | 36 |
| 110 | 154 | L397D | 449 | 37 |
| 111 | 155 | L397H | 450 | 38 |
| 112 | 156 | L397I | 449 | 37 |
| 113 | 157 | L397Q | 449 | 37 |
| 114 | 158 | L397R | 449 | 37 |
| 115 | 159 | L397T | 449 | 37 |
| 116 | 160 | L398E | 449 | 37 |
| 117 | 161 | L398G | 450 | 38 |
| 118 | 162 | L398N | 449 | 37 |
| 119 | 163 | L398Q | 450 | 38 |
| 120 | 164 | L398R | 449 | 37 |
| 368 | 409 | L44A/K206A/F217R/N247D/Q302K/L316D/M322I/A337P/K362Q/E367N/R373K | N.D. | 36 |
| 362 | 403 | L44C/K206A/F217R/N247D/Q302K/L316D/M322I/A337P/K362Q/E367N/R373K | N.D. | 32 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 360 | 401 | L44E/K206A/F217R/N247D/Q302K/L316D/M322I/A337P/K362Q/E367N/R373K | N.D. | 32 |
| 374 | 415 | L44M/K206A/F217R/N247D/Q302K/L316D/M322I/A337P/K362Q/E367N/R373K | N.D. | 33

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 451 | 492 | L44R/K206A/F217R/N247D/M259V/Q302K/L316D/M322I/A337P/ K362Q/E367N/R373K | N.D. | 35 |
| 444 | 485 | L44R/K206A/F217R/N247D/M259W/Q302K/L316D/M322I/A337P/ K362Q/E367N/R373K | N.D TABLE 7.1-continued Total Immunogenicity Score (TIS), and Immunogenic Hit Count (IHC) for GLA Variants

| Variant # | SEQ ID NO: | Active Mutations | TIS | IHC |
|---|---|---|---|---|
| 493 | 534 | L44R/K206A/F217R/N247D/Q302K/L316D/M322I/A337P/K362Q/E367N/R373K/M392P | N.D. | 30 |
| 461 | 502 | L44R/K206A/F217R/N247D/Q302K/L316D/M322I/A337P/K362Q/E367N/R373K/M392Q | N.D. | 35 |
| 478 | 519 | L44R/K206A/F217R/N247D/Q302K/L316D/M322I/A337P/K362Q/E367N/R373K/M392S | N.D. | 36 |
| 507 | 548 | L44R/K206A/F217R/N247D/Q302K/L316D/M322I/A337P/K362Q/E367N/R373K/M392T | N.D. | 30 |
| 484 | 525 | L44R/K206A/F217R/N247D/Q302K/L316D/M322I/A337P/K362Q/E367N/R373K/M392V | N.D. | 34 |
| 485 | 526 | L44R/K206A/F217R/N247D/Q302K/L316D/M322I/A337P/K362Q/E367N/R373K/M392W | N.D. | 30 |
| 503 | 544 | L44R/K206A/F217R/N247D/Q302K/L316D/M322I/A337P/K362Q/E367N/R373K/Q385C | N.D. | 30 |
| 482 | 523 | L44R/K206A/F217R/N247D/Q302K/L316D/M322I/A337P/K362Q/E367N/R373K/Q385G | N.D. | 30 |
| 469 | 510 | L44R/K206A/F217R/N247D/Q302K/L316D/M322I/A337P/K362Q/E367N/R373K/Q385I | N.D. | 36 |
| 462 | 503 | L44R/K206A/F217R/N247D/Q302K/L316D/M322I/A337P/K362Q/E367N/R373K/Q385L | N.D. | 36 |
| 509 | 550 | L44R/K206A/F217R/N247D/Q302K/L316D/M322I/A337P/K362Q/E367N/R373K/Q385T | N.D. | 30 |
| 506 | 547 | L44R/K206A/F217R/N247D/Q302K/L316D/M322I/A337P/K362Q/E367N/R373K/Q385W | N.D. | 30 |
| 514 | 555 | L44R/K206A/F217R/N247D/Q302K/L316D/M322I/A337P/K362Q/E367N/R373K/S393* | N.D. | 31 |
| 492 | 533 | L44R/K206A/F217R/N247D/Q302K/L316D/M322I/A337P/K362Q/E367N/R373K/T389C | N.D. | 32 |
| 475 | 516 | L44R/K206A/F217R/N247D/Q302K/L316D/M322I/A337P/K362Q/E367N/R373K/T389D | N.D. | 30 |
| 487 | 528 | L44R/K206A/F217R/N247D/Q302K/L316D/M322I/A337P/K362Q/E367N/R373K/T389G | N.D. | 30 |
| 489 | 530 | L44R/K206A/F217R/N247D/Q302K/L316D/M322I/A337P/K362Q/E367N/R373K/T389I | N.D. | 36 |
| 499 | 540 | L44R/K206A/F217R/N247D/Q302K/L316D/M322I/A337P/K362Q/E367N/R373K/T389L | N.D. | 35 |
| 456 | 497 | L44R/K206A/F217R/N247D/Q302K/L316D/M322I/A337P/K362Q/E367N/R373K/T389M | N.D. | 35 |
| 488 | 529 | L44R/K206A/F217R/N247D/Q302K/L316D/M322I/A337P/K362Q/E367N/R373K/T389N | N.D. | 30 |
| 495 | 536 | L44R/K206A/F217R/N247D/Q302K/L316D/M322I/A337P/K362Q/E367N/R373K/T389P | N.D. | 34 |
| 468 | 509 | L44R/K206A/F217R/N247D/Q302K/L316D/M322I/A337P/K362Q/E367N/R373K/T389Q | N.D. | 30 |
| 467 | 508 | L44R/K206A/F217R/N247D/Q302K/L316D/M322I/A337P/K362Q/E367N/R373K/T389S | N.D. | 30 |
| 471 | 512 | L44R/K206A/F217R/N247D/Q302K/L316D/M322I/A337P/K362Q/E367N/R373K/T389W | N.D. | 30 |
| 327 | 368 | L44R/K206A/F217R/N247D/Q302K/L316D/M322I/K343D/A350G/K362Q/E367N/R373K | 427 | 37 |
| 434 | 475 | L44R/K206A/F217R/N247D/R270D/Q302K/L316D/M322I/A337P/K362Q/E367N/R373K | N.D. | 36 |
| 431 | 472 | L44R/K206A/F217R/N247D/R270G/Q302K/L316D/M322I/A337P/K362Q/E367N/R373K | N.D. | 36 |
| 453 | 494 | L44R/K206A/F217R/N247D/R270L/Q302K/L316D/M322I/A337P/K362Q/E367N/R373K | N.D. | 36 |
| 448 | 489 | L44R/K206A/F217R/N247D/R270Q/Q302K/L316D/M322I/A337P/K362Q/E367N/R373K | N.D. | 36 |
| 280 | 321 | L44R/K206A/F217R/Q302K/E367D/T369D | 426 | 37 |
| 328 | 369 | L44R/K206A/F217R/Q302K/M322I/A337P/A350G/E367N/T369S/R373K | 452 | 42 |
| 329 | 370 | L44R/K206A/I208V/N247D/Q302K/M322I/K343D/E367N/R373K | 442 | 38 |
| 330 | 371 | L44R/K206A/I208V/R221K/M322I/K343D/E367N/R373K | 443 | 38 |
| 281 | 322 | L44R/K206A/I208V/R221K/M322V/K343D/F365L/R373K | 422 | 37 |
| 331 | 372 | L44R/K206A/I208V/R221K/N247D/Q302K/M322I/K343D/E367N/R373K/I376V | 441 | 38 |
| 332 | 373 | L44R/K206A/I208V/R221T/Q302K/M322I/K343D/F365L/E367N/R373K/I376V | 449 | 40 |
| 333 | 374 | L44R/K206A/L316D/M322I/A337P/A350G/E367N/T369S/R373K | 450 | 42 |
| 282 | 323 | L44R/K206A/N247D/A337P | 429 | 38 |
| 334 | 375 | L44R/K206A/N247D/L316D/M322I/A350G/K362Q/E367N/T369S/R373K | 443 | 42 |
| 283 | 324 | L44R/K206A/N247D/Q302K/A337P/A350G/E367D/T369D | 419 | 37 |
| 335 | 376 | L44R/K206A/N247D/Q302K/L316D/M322I/A337P/K343G/A350G/K362Q/E367N/T369S/R373K | 432 | 42 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 336 | 377 | L44R/K206A/N247D/Q302K/M322I/A350G/E367N/T369S/R373K | 457 | 42 |
| 337 | 378 | L44R/K206A/N247D/Q302K/M322I/K343D/E367N/R373K | 442 | 38 |
| 284 | 325 | L44R/K206A/R221T/N247D/M322I/K343D/F365L/I376V | 432 | 37 |
| 285 | 326 | L44R/K96I/K206A | 419 | 36 |
| 286 | 327 | L44R/K96I/K206A/F217R/N247D | 418 | 36 |
| 338 | 379 | L44R/K96I/K206A/F217R/N247D/L316D/M322I/A337P/A350G/K362Q/E367N/R373K | 410 | 35 |
| 339 | 380 | L44R/K96I/K206A/F217R/N247D/M322I/A350G/K362Q/E367N/R373K | 418 | 35 |
| 340 | 381 | L44R/K96I/K206A/F217R/N247D/M322I/A350G/K362Q/E367N/T369S/R373K | 428 | 40 |
| 341 | 382 | L44R/K96I/K206A/F217R/N247D/M322I/E367N/T369S/R373K | 440 | 40 |
| 287 | 328 | L44R/K96I/K206A/F217R/N247D/Q302K/A337P/A350G | 412 | 36 |
| 288 | 329 | L44R/K96I/K206A/F217R/N247D/Q302K/A337P/K343D/A350G/E367D/T369D | 397 | 35 |
| 342 | 383 | L44R/K96I/K206A/F217R/N247D/Q302K/L316D/M322I/A337P/E367N/R373K | 423 | 36 |
| 343 | 384 | L44R/K96I/K206A/F217R/N247D/Q302K/M322I/E367N/T369S/R373K | 440 | 40 |
| 344 | 385 | L44R/K96I/K206A/F217R/N247D/Q302K/M322I/K362Q/E367N/R373K | 418 | 35 |
| 345 | 386 | L44R/K96I/K206A/F217R/Q219P/N247D/M253K/S266F/D284E/Q290P/L293F/Q302K/V308G/S314F/M322I/A337P/K343E/E367N/R373K | 429 | 41 |
| 289 | 330 | L44R/K96I/K206A/F217R/Q302K/A350G | 419 | 36 |
| 346 | 387 | L44R/K96I/K206A/F217R/Q302K/M322I/A350G/K362Q/E367N/T369S/R373K | 429 | 40 |
| 347 | 388 | L44R/K96I/K206A/M322I/A337P/E367N/T369S/R373K | 435 | 40 |
| 290 | 331 | L44R/K96I/K206A/N247D/L316D/A337P/A350G/E367D/T369D | 400 | 35 |
| 291 | 332 | L44R/L100F/K206A/F365L | 426 | 38 |
| 292 | 333 | L44R/L100F/K206A/I208V/Q219H/N247D/Q302K/M322V/K343D/R373K/I376V | 416 | 37 |
| 348 | 389 | L44R/L100F/K206A/I208V/R221K/M322I/K343G/F365L/E367N/R373K | 442 | 40 |
| 293 | 334 | L44R/L100F/K206A/I208V/R221K/N247D/Q302K/M322V/F365L/I376V | 418 | 37 |
| 349 | 390 | L44R/L100F/K206A/I208V/R221T/N247D/M322I/F365L/E367N/R373K | 446 | 40 |
| 350 | 391 | L44R/L100F/K206A/I208V/R221T/N247D/M322V/E367N/R373K/I376V | 427 | 38 |
| 294 | 335 | L44R/L100F/K206A/I208V/R221T/N247D/M322V/I376V | 420 | 37 |
| 295 | 336 | L44R/L100F/K206A/I208V/R221T/N247D/Q302K/M322I/K343D/F365L/R373K/I376V | 424 | 37 |
| 351 | 392 | L44R/L100F/K206A/I208V/R221T/Q302K/M322I/E367N/R373K/I376V | 440 | 38 |
| 352 | 393 | L44R/L100F/K206A/Q302K/M322I/E367N/R373K/I376V | 440 | 38 |
| 353 | 394 | L44R/L100F/K206A/R221K/M322I/F365L/E367N/R373K/I376V | 446 | 40 |
| 354 | 395 | L44R/L100F/K206A/R221T/M322I/F365L/E367N/R373K | 447 | 40 |
| 355 | 396 | L44R/L100F/K206A/R221T/N247D/M322I/K343D/E367N/R373K/I376V | 433 | 38 |
| 356 | 397 | L44R/L100F/K206A/R221T/N247D/Q302K/M322I/E367N/R373K | 440 | 38 |
| 357 | 398 | L44R/L100F/K206A/R221T/N247D/Q302K/M322V/E367N/R373K/I376V | 427 | 38 |
| 358 | 399 | L44R/L100F/K206A/R221T/Q302K/M322I/E367N/R373K | 441 | 38 |
| 359 | 400 | L44R/L100F/Q181L/K206A/R221T/N247D/Q302K/M322V/E367N/R373K/I376V | 429 | 38 |
| 400 | 441 | L44R/L158C/K206A/F217R/N247D/Q302K/L316D/M322I/A337P/K362Q/E367N/R373K | N.D. | 34 |
| 405 | 446 | L44R/L158E/K206A/F217R/N247D/Q302K/L316D/M322I/A337P/K362Q/E367N/R373K | N.D. | 34 |
| 422 | 463 | L44R/L158G/K206A/F217R/N247D/Q302K/L316D/M322I/A337P/K362Q/E367N/R373K | N.D. | 34 |
| 407 | 448 | L44R/L158H/K206A/F217R/N247D/Q302K/L316D/M322I/A337P/K362Q/E367N/R373K | N.D. | 34 |
| 396 | 437 | L44R/L158M/K206A/F217R/N247D/Q302K/L316D/M322I/A337P/K362Q/E367N/R373K | N.D. | 39 |
| 414 | 455 | L44R/L158Q/K206A/F217R/N247D/Q302K/L316D/M322I/A337P/K362Q/E367N/R373K | N.D. | 34 |
| 397 | 438 | L44R/L158R/K206A/F217R/N247D/Q302K/L316D/M322I/A337P/K362Q/E367N/R373K | N.D. | 34 |
| 121 | 165 | L44R/L384F | 455 | 35 |
| 418 | 459 | L44R/N161E/K206A/F217R/N247D/Q302K/L316D/M322I/A337P/K362Q/E367N/R373K | N.D. | 34 |
| 523 | 564 | L44R/N91M/Y92H/K206A/F217R/N247D/Q302K/L316D/M322I/A337P/K362Q/E367N/R373K | 396 | 28 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 524 | 565 | L44R/N91V/Y92H/K206A/F217R/N247D/Q302K/L316D/M322I/A337P/K362Q/E367N/R373K | 398 | 27 |
| 525 | 566 | L44R/Q76H/Y92H/K206A/F217R/N247D/Q302K/L316D/M322I/A337P/K362Q/E367N/W368A/R373K | 388 | 23 |
| 423 | 464 | L44R/R162A/K206A/F217R/N247D/Q302K/L316D/M322I/A337P/K362Q/E367N/R373K | N.D. | 35 |
| 416 | 457 | L44R/R162G/K206A/F217R/N247D/Q302K/L316D/M322I/A337P/K362Q/E367N/R373K | N.D. | 34 |
| 410 | 451 | L44R/R162H/K206A/F217R/N247D/Q302K/L316D/M322I/A337P/K362Q/E367N/R373K | N.D. | 34 |
| 406 | 447 | L44R/R162K/K206A/F217R/N247D/Q302K/L316D/M322I/A337P/K362Q/E367N/R373K | N.D. | 34 |
| 421 | 462 | L44R/R162Q/K206A/F217R/N247D/Q302K/L316D/M322I/A337P/K362Q/E367N/R373K | N.D. | 36 |
| 417 | 458 | L44R/R162S/K206A/F217R/N247D/Q302K/L316D/M322I/A337P/K362Q/E367N/R373K | N.D. | 36 |
| 409 | 450 | L44R/R165H/K206A/F217R/N247D/Q302K/L316D/M322I/A337P/K362Q/E367N/R373K | N.D. | 36 |
| 399 | 440 | L44R/R165K/K206A/F217R/N247D/Q302K/L316D/M322I/A337P/K362Q/E367N/R373K | N.D. | 36 |
| 526 | 567 | L44R/R74H/Y92H/K206A/F217R/N247D/Q302K/L316D/M322I/A337P/K362Q/E367N/R373K | 393 | 24 |
| 411 | 452 | L44R/S166A/K206A/F217R/N247D/Q302K/L316D/M322I/A337P/K362Q/E367N/R373K | N.D. | 34 |
| 415 | 456 | L44R/S166D/K206A/F217R/N247D/Q302K/L316D/M322I/A337P/K362Q/E367N/R373K | N.D. | 34 |
| 419 | 460 | L44R/S166E/K206A/F217R/N247D/Q302K/L316D/M322I/A337P/K362Q/E367N/R373K | N.D. | 34 |
| 404 | 445 | L44R/S166F/K206A/F217R/N247D/Q302K/L316D/M322I/A337P/K362Q/E367N/R373K | N.D. | 36 |
| 403 | 444 | L44R/S166G/K206A/F217R/N247D/Q302K/L316D/M322I/A337P/K362Q/E367N/R373K | N.D. | 35 |
| 412 | 453 | L44R/S166H/K206A/F217R/N247D/Q302K/L316D/M322I/A337P/K362Q/E367N/R373K | N.D. | 34 |
| 402 | 42 | L44R/S166P/K206A/F217R/N247D/Q302K/L316D/M322I/A337P/K362Q/E367N/R373K | N.D. | 34 |
| 408 | 449 | L44R/S166R/K206A/F217R/N247D/Q302K/L316D/M322I/A337P/K362Q/E367N/R373K | N.D. | 36 |
| 420 | 461 | L44R/S166T/K206A/F217R/N247D/Q302K/L316D/M322I/A337P/K362Q/E367N/R373K | N.D. | 34 |
| 363 | 404 | L44R/S47D/K206A/F217R/N247D/Q302K/L316D/M322I/A337P/K362Q/E367N/R373K | N.D. | 36 |
| 375 | 416 | L44R/S47I/K206A/F217R/N247D/Q302K/L316D/M322I/A337P/K362Q/E367N/R373K | N.D. | 36 |
| 365 | 406 | L44R/S47N/K206A/F217R/N247D/Q302K/L316D/M322I/A337P/K362Q/E367N/R373K | N.D. | 36 |
| 623 | 664 | L44R/S47N/S166P/K206A/F217R/N247D/H271A/A276S/Q302K/L316D/M322I/A337P/K362Q/E367N/R373K/M392T | 386 | 25 |
| 624 | 665 | L44R/S47N/S166P/K206A/F217R/N247D/H271A/Q302K/L316D/M322I/A337P/K362Q/E367N/R373K/M390Q | 385 | 25 |
| 628 | 668 | L44R/S47N/Y92H/S166P/K206A/F217R/N247D/H271A/Q302K/L316D/M322I/A337P/K362Q/E367N/R373K/M390H | 350 | 12 |
| 613 | 654 | L44R/S47N/Y92H/S166P/K206A/F217R/N247D/H271A/Q302K/L316D/M322I/A337P/K362Q/E367N/R373K/M390Q | 351 | 12 |
| 632 | 672 | L44R/S47N/Y92H/S166P/K206A/F217R/N247D/H271A/Q302K/L316D/M322I/A337P/K362Q/E367N/R373K/M392T | 352 | 12 |
| 627 | 667 | L44R/S47N/Y92H/S166P/K206A/F217R/N247D/M259W/H271A/Q302K/L316D/M322I/A337P/K362Q/E367N/R373K/M390H/M392T | 311 | 5 |
| 622 | 663 | L44R/S47N/Y92H/S166P/K206A/F217R/N247D/M259W/H271A/Q302K/L316D/M322I/A337P/K362Q/E367N/R373K/M390Q/M392T | 305 | 5 |
| 615 | 656 | L44R/S47N/Y92H/S166P/K206A/F217R/N247D/Q302K/L316D/M322I/A337P/K362Q/E367N/R373K/M390H | 352 | 13 |
| 361 | 402 | L44R/S47R/K206A/F217R/N247D/Q302K/L316D/M322I/A337P/K362Q/E367N/R373K | N.D. | 36 |
| 631 | 671 | L44R/S47T/A53S/Y92H/S166P/K206A/F217R/N247D/H271A/Q302K/L316D/M322I/A337P/K362Q/E367N/R373K/M390Q | 344 | 8 |
| 379 | 420 | L44R/S47T/K206A/F217R/N247D/Q302K/L316D/M322I/A337P/K362Q/E367N/R373K | N.D. | 32 |
| 675 | 715 | L44R/S47T/M65V/Y92H/S166P/K206A/F217R/N247D/H271A/Q302K/L316D/M322I/A337P/K362Q/E367N/R373K/M392T | 344 | 8 |
| 657 | 697 | L44R/S47T/P67T/Y92H/S166P/K182N/K206A/F217R/N247D/H271A/Q302K/L316D/M322I/A337P/K362Q/E367N/R373K/M392T | 338 | 8 |
| 629 | 669 | L44R/S47T/S166P/K206A/F217R/N247D/H271A/Q302K/L316D/M322I/A337P/K362Q/E367N/R373K/M390Q | 378 | 21 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 659 | 699 | L44R/S47T/W64L/Y92H/S166P/K206A/F217R/N247D/H271A/ Q302K/L316D/M322I/A337P/K362Q/E367N/R373K/M392T | 345 | 8 |
| 672 | 712 | L44R/S47T/Y92H/D144Y/S166P/K206A/F217R/N247D/H271A/ Q302K/L316D/M322I/A337P/K362Q/E367N/R373K/M392T | 351 | 8 |
| 646 | 686 | L44R/S47T/Y92H/G113C/S166P/K206A/F217R/N247D/H271A/ Q302K/L316D/M322I/A337P/K362Q/E367N/R373K/M392T | 345 | 8 |
| 644 | 684 | L44R/S47T/Y92H/S166P/K206A/F217R/L237P/N247D/H271A/ Q302K/L316D/M322I/A337P/K362Q/E367N/R373K/M392T | 338 | 8 |
| 687 | 727 | L44R/S47T/Y92H/S166P/K206A/F217R/N247D/H271A/Q290R/ Q302K/L316D/M322I/A337P/K362Q/E367N/W368A/R373K/M392T | 340 | 7 |
| 618 | 659 | L44R/S47T/Y92H/S166P/K206A/F217R/N247D/H271A/Q302K/ L316D/M322I/A337P/K362Q/E367N/R373K | 361 | 15 |
| 619 | 660 | L44R/S47T/Y92H/S166P/K206A/F217R/N247D/H271A/Q302K/ L316D/M322I/A337P/K362Q/E367N/R373K/M390H | 343 | 8 |
| 620 | 661 | L44R/S47T/Y92H/S166P/K206A/F217R/N247D/H271A/Q302K/ L316D/M322I/A337P/K362Q/E367N/R373K/M390Q | 344 | 8 |
| 625 | 44 | L44R/S47T/Y92H/S166P/K206A/F217R/N247D/H271A/Q302K/ L316D/M322I/A337P/K362Q/E367N/R373K/M392T | 345 | 8 |
| 673 | 713 | L44R/S47T/Y92H/S166P/K206A/F217R/N247D/H271A/Q302K/ L316D/M322I/A337P/K362Q/E367N/R373K/N377Y/M392T | 331 | 7 |
| 693 | 733 | L44R/S47T/Y92H/S166P/K206A/F217R/N247D/H271A/Q302K/ L316D/M322I/A337P/K362Q/E367N/W368A/R373K/M392T | 340 | 7 |
| 682 | 722 | L44R/S47T/Y92H/S166P/K206A/F217R/N247D/H271A/Q302K/ L316Y/M322I/A337P/K362Q/E367N/R373K/M392T | 348 | 8 |
| 670 | 710 | L44R/S47T/Y92H/S166P/K206A/F217R/N247D/H271A/Q302K/ N305L/L316D/M322I/A337P/K362Q/E367N/R373K/M392T | 345 | 8 |
| 689 | 729 | L44R/S47T/Y92H/S166P/K206A/F217R/N247D/H271A/Q302K/ N305L/L316D/M322I/A337P/K362Q/E367N/R373K/M392T | 345 | 8 |
| 684 | 724 | L44R/S47T/Y92H/S166P/K206A/F217R/N247D/H271A/Q302K/ N305L/L316D/M322I/A337P/K362Q/E367N/W368A/R373K/M392T | 340 | 7 |
| 678 | 718 | L44R/S47T/Y92H/S166P/K206A/F217R/N247D/M253W/A257G/ H271A/K277R/Q281L/Q302K/L316D/A319D/M322I/A337P/K362Q/ E367N/R373K/M392T | 339 | 7 |
| 677 | 717 | L44R/S47T/Y92H/S166P/K206A/F217R/N247D/M253W/H271A/ S273D/P274S/K277R/Q302K/L316D/M322I/A337P/K362Q/E367N/ R373K/M392T | 338 | 7 |
| 621 | 662 | L44R/S47T/Y92H/S166P/K206A/F217R/N247D/M259E/H271A/ Q302K/L316D/M322I/A337P/K362Q/E367N/R373K/M390Q | 307 | 1 |
| 610 | 651 | L44R/S47T/Y92H/S166P/K206A/F217R/N247D/M259E/Q302K/ L316D/M322I/A337P/K362Q/E367N/R373K/M390Q | 310 | 2 |
| 630 | 670 | L44R/S47T/Y92H/S166P/K206A/F217R/N247D/M259W/H271A/ Q302K/L316D/M322I/A337P/K362Q/E367N/R373K/M390H | 311 | 1 |
| 616 | 657 | L44R/S47T/Y92H/S166P/K206A/F217R/N247D/M259W/H271A/ Q302K/L316D/M322I/A337P/K362Q/E367N/R373K/M390Q | 312 | 1 |
| 669 | 709 | L44R/S47T/Y92H/S166P/K206A/F217R/N247D/P262S/H271A/ Q302K/L316D/M322I/A337P/K362Q/E367N/R373K/M392T | 353 | 8 |
| 614 | 655 | L44R/S47T/Y92H/S166P/K206A/F217R/N247D/Q302K/L316D/ M322I/A337P/K362Q/E367N/R373K | 363 | 16 |
| 692 | 732 | L44R/S47T/Y92H/S166P/K206A/F217R/N247D/W256L/H271/ Q302K/L316D/M322I/A337P/K362Q/E367N/R373K/M392T | 347 | 8 |
| 666 | 706 | L44R/S47T/Y92H/S166P/K206A/F217R/P228L/N247D/H271A/ Q302K/L316D/M322I/A337P/K362Q/E367N/R373K/M392T | 345 | 8 |
| 688 | 728 | L44R/S47T/Y92H/S166P/K206A/F217R/P228Q/N247D/H271A/ Q302K/L316D/M322I/A337P/K362Q/E367N/R373K/M392T | 345 | 8 |
| 674 | 714 | L44R/S47T/Y92H/S166P/K206A/F217R/P234H/N247D/H271A/ Q302K/L316D/M322I/A337P/K362Q/E367N/R373K/M392T | 345 | 8 |
| 662 | 702 | L44R/S47T/Y92H/S166P/K206A/F217R/V238I/N247D/H271A/ Q302K/L316D/M322I/A337P/K362Q/E367N/R373K/M392T | 347 | 8 |
| 652 | 692 | L44R/S47T/Y92H/S166P/K206A/F217R/W246P/N247D/A261G/ H271A/Q302K/N305L/L316D/M322I/A337P/K362Q/E367N/R373K/ M392T | 312 | 1 |
| 655 | 695 | L44R/S47T/Y92H/S166P/K206A/F217R/W246P/N247D/A261G/ H271A/Q302K/N305L/L316D/M322I/A337P/K362Q/E367N/W368A/ R373K/M392T | 307 | 0 |
| 645 | 685 | L44R/S47T/Y92H/S166P/P174S/K206A/F217R/N247D/H271A/ Q302K/L316D/M322I/A337P/K362Q/E367N/R373K/M392T | 340 | 8 |
| 661 | 701 | L44R/S47T/Y92H/S166P/W195C/K206A/F217R/N247D/H271A/ Q302K/L316D/M322I/A337P/K362Q/E367N/R373K/M392T | 345 | 8 |
| 366 | 407 | L44R/S47V/K206A/F217R/N247D/Q302K/L316D/M322I/A337P/ K362Q/E367N/R373K | N.D. | 36 |
| 401 | 442 | L44R/T163S/K206A/F217R/N247D/Q302K/L316D/M322I/A337P/ K362Q/E367N/R373K | N.D. | 34 |
| 388 | 429 | L44R/V93L/K206A/F217R/N247D/Q302K/L316D/M322I/A337P/ K362Q/E367N/R373K | N.D. | 36 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 389 | 430 | L44R/V93S/K206A/F217R/N247D/Q302K/L316D/M322I/A337P/K362Q/E367N/R373K | N.D. | 29 |
| 387 | 428 | L44R/V93T/K206A/F217R/N247D/Q302K/L316D/M322I/A337P/K362Q/E367N/R373K | N.D. | 31 |
| 385 | 426 | L44R/Y92A/K206A/F217R/N247D/Q302K/L316D/M322I/A337P/K362Q/E367N/R373K | N.D. | 25 |
| 383 | 424 | L44R/Y92C/K206A/F217R/N247D/Q302K/L316D/M322I/A337P/K362Q/E367N/R373K | N.D. | 24 |
| 527 | 568 | L44R/Y92E/K206A/F217R/N247D/Q302K/L316D/M322I/A337P/K362Q/E367N/R373K | 377 | 24 |
| 393 | 434 | L44R/Y92G/K206A/F217R/N247D/Q302K/L316D/M322I/A337P/K362Q/E367N/R373K | N.D. | 24 |
| 528 | 569 | L44R/Y92H/D130Q/K206A/F217R/N247D/Q302K/L316D/M322I/A337P/K362Q/E367N/R373K | 393 | 24 |
| 529 | 570 | L44R/Y92H/K182A/K206A/F217R/N247D/Q302K/L316D/M322I/A337P/K362Q/E367N/R373K | 386 | 24 |
| 530 | 571 | L44R/Y92H/K182E/K206A/F217R/N247D/Q302K/L316D/M322I/A337P/K362Q/E367N/R373K | 386 | 24 |
| 531 | 572 | L44R/Y92H/K182H/K206A/F217R/N247D/Q302K/L316D/M322I/A337P/K362Q/E367N/R373K | 386 | 24 |
| 532 | 573 | L44R/Y92H/K182M/K206A/F217R/N247D/Q302K/L316D/M322I/A337P/K362Q/E367N/R373K | 386 | 24 |
| 533 | 574 | L44R/Y92H/K182Q/K206A/F217R/N247D/Q302K/L316D/M322I/A337P/K362Q/E367N/R373K | 386 | 24 |
| 534 | 575 | L44R/Y92H/K182R/K206A/F217R/N247D/Q302K/L316D/M322I/A337P/K362Q/E367N/R373K | 386 | 24 |
| 535 | 576 | L44R/Y92H/K182T/K206A/F217R/N247D/Q302K/L316D/M322I/A337P/K362Q/E367N/R373K | 386 | 24 |
| 536 | 577 | L44R/Y92H/K182V/K206A/F217R/N247D/Q302K/L316D/M322I/A337P/K362Q/E367N/R373K | 386 | 24 |
| 537 | 578 | L44R/Y92H/K182Y/K206A/F217R/N247D/Q302K/L316D/M322I/A337P/K362Q/E367N/R373K | 386 | 24 |
| 538 | 579 | L44R/Y92H/K206A/F217R/N247D/A287C/Q302K/L316D/M322I/A337P/K362Q/E367N/R373K | 392 | 24 |
| 539 | 580 | L44R/Y92H/K206A/F217R/N247D/A287H/Q302K/L316D/M322I/A337P/K362Q/E367N/R373K | 394 | 24 |
| 540 | 581 | L44R/Y92H/K206A/F217R/N247D/A287M/Q302K/L316D/M322I/A337P/K362Q/E367N/R373K | 404 | 24 |
| 541 | 582 | L44R/Y92H/K206A/F217R/N247D/K283A/Q302K/L316D/M322I/A337P/K362Q/E367N/R373K | 384 | 24 |
| 542 | 583 | L44R/Y92H/K206A/F217R/N247D/K283G/Q302K/L316D/M322I/A337P/K362Q/E367N/R373K | 387 | 24 |
| 543 | 584 | L44R/Y92H/K206A/F217R/N247D/K283M/Q302K/L316D/M322I/A337P/K362Q/E367N/R373K | 385 | 24 |
| 544 | 585 | L44R/Y92H/K206A/F217R/N247D/K283V/Q302K/L316D/M322I/A337P/K362Q/E367N/R373K | 385 | 24 |
| 545 | 586 | L44R/Y92H/K206A/F217R/N247D/K295A/Q302K/L316D/M322I/A337P/K362Q/E367N/R373K | 393 | 24 |
| 546 | 587 | L44R/Y92H/K206A/F217R/N247D/K295E/Q302K/L316D/M322I/A337P/K362Q/E367N/R373K | 392 | 24 |
| 547 | 588 | L44R/Y92H/K206A/F217R/N247D/K295L/Q302K/L316D/M322I/A337P/K362Q/E367N/R373K | 409 | 24 |
| 548 | 589 | L44R/Y92H/K206A/F217R/N247D/K295N/Q302K/L316D/M322I/A337P/K362Q/E367N/R373K | 391 | 24 |
| 549 | 590 | L44R/Y92H/K206A/F217R/N247D/K295Q/Q302K/L316D/M322I/A337P/K362Q/E367N/R373K | 393 | 24 |
| 550 | 591 | L44R/Y92H/K206A/F217R/N247D/K295S/Q302K/L316D/M322I/A337P/K362Q/E367N/R373K | 393 | 24 |
| 551 | 592 | L44R/Y92H/K206A/F217R/N247D/K295T/Q302K/L316D/M322I/A337P/K362Q/E367N/R373K | 392 | 24 |
| 552 | 593 | L44R/Y92H/K206A/F217R/N247D/Q302K/L316D/A317D/M322I/A337P/K362Q/E367N/R373K | 393 | 24 |
| 553 | 594 | L44R/Y92H/K206A/F217R/N247D/Q302K/L316D/A317Q/M322I/A337P/K362Q/E367N/R373K | 393 | 24 |
| 554 | 595 | L44R/Y92H/K206A/F217R/N247D/Q302K/L316D/M322I/A337P/A346G/K362Q/E367N/R373K | 388 | 24 |
| 555 | 596 | L44R/Y92H/K206A/F217R/N247D/Q302K/L316D/M322I/A337P/G344A/K362Q/E367N/R373K | 395 | 24 |
| 556 | 597 | L44R/Y92H/K206A/F217R/N247D/Q302K/L316D/M322I/A337P/G344D/K362Q/E367N/R373K | 388 | 24 |
| 557 | 598 | L44R/Y92H/K206A/F217R/N247D/Q302K/L316D/M322I/A337P/G344S/K362Q/E367N/R373K | 388 | 24 |
| 558 | 599 | L44R/Y92H/K206A/F217R/N247D/Q302K/L316D/M322I/A337P/I353L/K362Q/E367N/R373K | 391 | 24 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 559 | 600 | L44R/Y92H/K206A/F217R/N247D/Q302K/L316D/M322I/A337P/ K362Q/E367N/L372W/R373K | 386 | 23 |
| 395 | 40 | L44R/Y92H/K206A/F217R/N247D/Q302K/L316D/M322I/A337P/ K362Q/E367N/R373K | N.D. | 24 |
| 560 | 601 | L44R/Y92H/K206A/F217R/N247D/Q302K/L316D/M322I/A337P/ K362Q/E367N/W368A/R373K | 388 | 23 |
|

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 611 | 652 | L44R/Y92H/S166P/K206A/F217R/N247D/Q302K/L316D/M322I/A337P/K362Q/E367N/R373K/M390Q | 360 | 14 |
| 612 | 953 | L44R/Y92H/S166P/K206A/F217R/N247D/Q302K/L316D/M322I/A337P/K362Q/E367N/R373K/M392T | 361 | 14 |
| 593 | 634 | L44R/Y92H/S95A/K206A/F217R/N247D/Q302K/L316D/M322I/A337P/K362Q/E367N/R373K | 396 | 27 |
| 594 | 635 | L44R/Y92H/S95E/K206A/F217R/N247D/Q302K/L316D/M322I/A337P/K362Q/E367N/R373K | 375 | 24 |
| 595 | 636 | L44R/Y92H/T186A/K206A/F217R/N247D/Q302K/L316D/M322I/A337P/K362Q/E367N/R373K | 393 | 24 |
| 596 | 637 | L44R/Y92H/T186G/K206A/F217R/N247D/Q302K/L316D/M322I/A337P/K362Q/E367N/R373K | 393 | 24 |
| 597 | 638 | L44R/Y92H/T186V/K206A/F217R/N247D/Q302K/L316D/M322I/A337P/K362Q/E367N/R373K | 401 | 24 |
| 598 | 639 | L44R/Y92H/Y120H/K206A/F217R/N247D/Q302K/L316D/M322I/A337P/K362Q/E367N/R373K | 393 | 24 |
| 599 | 640 | L44R/Y92H/Y120S/K206A/F217R/N247D/Q302K/L316D/M322I/A337P/K362Q/E367N/R373K | 393 | 24 |
| 600 | 641 | L44R/Y92H/Y120S/K206A/F217R/N247D/Q302K/L316D/M322I/A337P/L341F/K362Q/E367N/R373K | 388 | 24 |
| 380 | 421 | L44R/Y92K/K206A/F217R/N247D/Q302K/L316D/M322I/A337P/K362Q/E367N/R373K | N.D. | 24 |
| 390 | 431 | L44R/Y92Q/K206A/F217R/N247D/Q302K/L316D/M322I/A337P/K362Q/E367N/R373K | N.D. | 24 |
| 394 | 435 | L44R/Y92R/K206A/F217R/N247D/Q302K/L316D/M322I/A337P/K362Q/E367N/R373K | N.D. | 30 |
| 381 | 422 | L44R/Y92S/K206A/F217R/N247D/Q302K/L316D/M322I/A337P/K362Q/E367N/R373K | N.D. | 24 |
| 392 | 433 | L44R/Y92T/K206A/F217R/N247D/Q302K/L316D/M322I/A337P/K362Q/E367N/R373K | N.D. | 24 |
| 384 | 425 | L44R/Y92V/K206A/F217R/N247D/Q302K/L316D/M322I/A337P/K362Q/E367N/R373K | N.D. | 35 |
| 369 | 410 | L44S/K206A/F217R/N247D/Q302K/L316D/M322I/A337P/K362Q/E367N/R373K | N.D. | 36 |
| 122 | 166 | L44T | 456 | 37 |
| 378 | 419 | L44T/K206A/F217R/N247D/Q302K/L316D/M322I/A337P/K362Q/E367N/R373K | N.D. | 36 |
| 372 | 413 | L44V/K206A/F217R/N247D/Q302K/L316D/M322I/A337P/K362Q/E367N/R373K | N.D. | 36 |
| 371 | 412 | L44W/K206A/F217R/N247D/Q302K/L316D/M322I/A337P/K362Q/E367N/R373K | N.D. | 32 |
| 123 | 167 | M20D/Q302K | 450 | 38 |
| 124 | 168 | M253F | 444 | 38 |
| 125 | 169 | M322I | 462 | 38 |
| 126 | 170 | M390D | 425 | 31 |
| 127 | 171 | M390R | 430 | 31 |
| 128 | 172 | M390T | 438 | 35 |
| 129 | 173 | M392G | 435 | 31 |
| 130 | 174 | M392P | 433 | 31 |
| 131 | 175 | M392S | 448 | 37 |
| 601 | 642 | M39C/L44R/Y92H/K206A/F217R/N247D/Q302K/L316D/M322I/A337P/K362Q/E367N/R373K | 367 | 19 |
| 683 | 723 | M39E/E43D/L44R/S47T/Y92H/S166P/K206A/F217R/W246P/N247D/M253W/H271A/S273D/Q302K/L316D/M322I/A337P/K362Q/E367N/W368A/R373K/M392T | 309 | 6 |
| 660 | 700 | M39E/L44R/S47T/Y92H/S166P/K206A/F217R/N247D/A261G/H271A/Q302K/N305L/L316D/M322I/A337P/K362Q/E367N/R373K/M392T | 302 | 1 |
| 668 | 708 | M39E/L44R/S47T/Y92H/S166P/K206A/F217R/N247D/H271A/Q302K/L316D/M322I/A337P/K362Q/E367N/R373K/M392T | 329 | 8 |
| 676 | 716 | M39E/L44R/S47T/Y92H/S166P/K206A/F217R/N247D/H271A/Q302K/L316D/M322I/A337P/K362Q/E367N/W368A/R373K/M392T | 324 | 7 |
| 639 | 679 | M39E/L44R/S47T/Y92H/S166P/K206A/F217R/N247Y/H271A/Q302K/L316D/M322I/A337P/K362Q/E367N/R373K/M392T | 343 | 8 |
| 658 | 698 | M39E/L44R/S47T/Y92H/S166P/K206A/F217R/W246P/N247D/H271A/Q302K/L316D/M322I/A337P/K362Q/E367N/R373K/M392T | 323 | 8 |
| 602 | 643 | M39E/L44R/Y92H/K206A/F217R/N247D/Q302K/L316D/M322I/A337P/K362Q/E367N/R373K | 363 | 19 |
| 364 | 405 | M39H/L44R/K206A/F217R/N247D/Q302K/L316D/M322I/A337P/K362Q/E367N/R373K | N.D. | 32 |
| 367 | 408 | M39R/L44R/K206A/F217R/N247D/Q302K/L316D/M322I/A337P/K362Q/E367N/R373K | N.D. | 32 |
| 603 | 644 | M39R/L44R/Y92H/K206A/F217R/N247D/Q302K/L316D/M322I/A337P/K362Q/E367N/R373K | 368 | 19 |
| 377 | 418 | M39T/L44R/K206A/F217R/N247D/Q302K/L316D/M322I/A337P/K362Q/E367N/R373K | N.D. | 32 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 604 | 645 | M39V/L44R/Y92H/K206A/F217R/N247D/Q302K/L316D/M322I/A337P/K362Q/E367N/R373K | 393 | 24 |
| 132 | 176 | M39Y | 451 | 37 |
| 376 | 417 | M41P/L44R/K206A/F217R/N247D/Q302K/L316D/M322I/A337P/K362Q/E367N/R373K | N.D. | 35 |
| 373 | 414 | M41R/L44R/K206A/F217R/N247D/Q302K/L316D/M322I/A337P/K362Q/E367N/R373K | N.D. | 36 |
| 133 | 177 | N388R | 454 | 38 |
| 134 | 178 | N91Q | 438 | 32 |
| 26 | 72 | P179S/R373K | 430 | 37 |
| 135 | 179 | Q190S/T369D | 448 | 38 |
| 136 | 180 | Q249A | 449 | 38 |
| 27 | 73 | Q299R/M322V/R373K | 451 | 37 |
| 28 | 74 | Q299R/Q302K/R373K | 451 | 37 |
| 29 | 75 | Q299R/Q302K/R373K/I376V | 450 | 37 |
| 137 | 181 | Q302A | 450 | 38 |
| 30 | 76 | Q302K/I376V | 443 | 37 |
| 138 | 182 | Q385H | 435 | 32 |
| 139 | 183 | Q385I | 447 | 38 |
| 140 | 184 | Q385L | 445 | 38 |
| 141 | 185 | Q391G | 449 | 36 |
| 142 | 186 | Q80A | 450 | 38 |
| 143 | 187 | Q80H | 450 | 38 |
| 144 | 188 | Q80V | 459 | 38 |
| 145 | 189 | Q88A | 448 | 38 |
| 146 | 190 | Q88F | 456 | 38 |
| 147 | 191 | Q88H | 448 | 38 |
| 148 | 192 | Q88R | 448 | 38 |
| 149 | 193 | Q88S | 448 | 38 |
| 150 | 194 | R162H | 446 | 35 |
| 151 | 195 | R162S | 450 | 37 |
| 225 | 226 | R165S/K206A | 427 | 39 |
| 152 | 196 | R221K/A350G | 450 | 38 |
| 153 | 197 | R221T | 450 | 38 |
| 154 | 198 | R301I/K362T | 449 | 41 |
| 155 | 199 | R301L | 450 | 38 |
| 156 | 200 | R371S | 456 | 39 |
| 157 | 201 | R371V | 452 | 40 |
| 31 | 77 | R373K | 444 | 37 |
| 32 | 78 | R373K/I376V | 443 | 37 |
| 665 | 705 | R7C/L44R/S47T/Y92H/S166P/K206A/F217R/N247D/H271A/Q302K/L316D/M322I/A337P/K362Q/E367N/W368A/R373K/M392T | 340 | 7 |
| 650 | 690 | R7H/T10P/L44R/S47T/Y92H/S166P/K206A/F217R/N247D/H271A/Q302K/L316D/M322I/A337P/K362Q/E367N/R373K/M392T | 345 | 8 |
| 681 | 721 | R7P/L44R/S47T/Y92H/S166P/K206A/F217R/N247D/H271A/Q302K/L316D/M322I/A337P/K362Q/E367N/R373K/M392T | 345 | 8 |
| 654 | 694 | R7S/L44R/S47T/Y92H/S166P/K206A/F217R/N247D/H271A/Q302K/L316D/M322I/A337P/K362Q/E367N/R373K/M392T | 345 | 8 |
| 158 | 202 | R87K | 435 | 32 |
| 159 | 203 | R87P/L398R | 423 | 31 |
| 160 | 204 | S166A | 440 | 35 |
| 161 | 205 | S166H | 447 | 35 |
| 162 | 206 | S166K | 441 | 35 |
| 163 | 207 | S31D | 450 | 38 |
| 164 | 208 | S34D/M392P | 439 | 31 |
| 165 | 209 | S34G | 450 | 38 |
| 166 | 210 | S34H/M390R | 430 | 31 |
| 167 | 211 | S34R | 450 | 38 |
| 168 | 212 | S374M | 454 | 40 |
| 169 | 213 | S374T | 439 | 37 |
| 170 | 214 | S393E | 447 | 37 |
| 171 | 215 | S393G | 447 | 37 |
| 172 | 216 | S393H | 454 | 38 |
| 173 | 217 | S393P | 452 | 37 |
| 174 | 218 | S47I | 450 | 38 |
| 175 | 219 | S47R | 459 | 38 |
| 176 | 220 | S47T | 433 | 33 |
| 177 | 221 | S95D | 422 | 31 |
| 178 | 222 | S95E | 414 | 31 |
| 179 | 223 | S95Q | 446 | 36 |
| 686 | 728 | T10P/E17G/L44R/S47T/Y92H/S166P/K206A/F217R/N247D/H271A/Q302K/L316D/M322I/A337P/K362Q/E367N/R373K/M392T | 352 | 8 |
| 642 | 682 | T10P/E43D/L44R/S47T/Y92H/S166P/K206A/F217R/N247D/A261G/H271A/Q302K/N305L/L316D/M322I/A337P/K362Q/E367N/W368A/R373K/M392T | 315 | 1 |

TABLE 7.1-continued

Total Immunogenicity Score (TIS), and Immunogenic Hit Count (IHC) for GLA Variants

| Variant # | SEQ ID NO: | Active Mutations | TIS | IHC |
|---|---|---|---|---|
| 690 | 730 | T10P/L44R/S47T/Y92H/M156V/S166P/K206A/F217R/N247D/H271A/Q302K/L316D/M322I/A337P/K362Q/E367N/R373K/M392T | 333 | 8 |
| 638 | 678 | T10P/L44R/S47T/Y92H/S166P/K206A/F217R/N247D/A261G/H271A/Q302K/L316D/M322I/A337P/K362Q/E367N/R373K/M392T | 318 | 1 |
| 651 | 691 | T10P/L44R/S47T/Y92H/S166P/K206A/F217R/N247D/H271A/Q302K/L316D/M322I/A337P/K362Q/E367N/R373K/M392T | 345 | 8 |
| 691 | 731 | T10P/L44R/S47T/Y92H/S166P/K206A/F217R/N247D/H271A/Q302K/L316D/M322I/A337P/K362Q/E367N/R373K/M392T | 345 | 8 |
| 671 | 711 | T10P/L44R/S47T/Y92H/S166P/K206A/F217R/N247D/H271A/Q302K/L316D/M322I/A337P/K362Q/E367N/W368A/R373K/M392T | 340 | 7 |
| 643 | 683 | T10P/L44R/S47T/Y92H/S166P/K206A/F217R/N247D/H271A/Q302K/L316D/M322I/R325S/A337P/K362Q/E367N/R373K/M392T | 335 | 8 |
| 664 | 704 | T10P/L44R/S47T/Y92H/S166P/K206A/F217R/N247D/Q252H/M253R/A254E/A261G/H271A/Q302K/L316D/M322I/A337P/K362Q/E367N/R373K/M392T | 312 | 2 |
| 656 | 696 | T10P/L44R/S47T/Y92H/S166P/K206A/F217R/W246P/N247D/A261G/H271A/Q302K/L316D/M322I/A337P/K362Q/E367N/R373K/M392T | 312 | 1 |
| 653 | 693 | T10P/L44R/S47T/Y92H/S166P/K206A/F217R/W246P/N247D/H271A/Q302K/L316D/M322I/A337P/K362Q/E367N/R373K/M392T | 339 | 8 |
| 605 | 646 | T10P/L44R/Y92H/K206A/F217R/N247D/Q302K/L316D/M322I/A337P/K362Q/E367N/R373K | 393 | 24 |
| 606 | 647 | T10P/L44R/Y92H/R189L/K206A/F217R/N247D/Q302K/L316D/M322I/A337P/K362Q/E367N/R373K | 395 | 24 |
| 640 | 680 | T10P/M39E/E43D/L44R/S47T/Y92H/S166P/K206A/F217R/N247D/H271A/Q302K/L316D/M322I/A337P/K362Q/E367N/R373K/M392T | 329 | 8 |
| 648 | 46 | T10P/M39E/L44R/S47T/Y92H/S166P/K206A/F217R/N247D/A261G/H271A/Q302K/L316D/M322I/A337P/K362Q/E367N/W368A/R373K/M392T | 297 | 0 |
| 680 | 720 | T10P/M39E/L44R/S47T/Y92H/S166P/K206A/F217R/N247D/H271A/Q302K/L316D/M322I/A337P/K362Q/E367N/R373K/M392T | 329 | 8 |
| 679 | 719 | T10P/M39E/L44R/S47T/Y92H/S166P/K206A/F217R/N247D/H271A/Q302K/N305L/L316D/M322I/A337P/K362Q/E367N/R373K/M392T | 329 | 8 |
| 641 | 681 | T10P/M39E/L44R/S47T/Y92H/S166P/K206A/F217R/N247D/S266P/H271A/Q302K/L316D/M322I/A337P/K362Q/E367N/R373K/M392T | 313 | 8 |
| 649 | 689 | T10P/M39E/L44R/S47T/Y92H/S166P/K206A/F217R/W246P/N247D/H271A/Q302K/L316D/M322I/A337P/K362Q/E367N/R373K/M392T | 323 | 8 |
| 180 | 224 | T369D | 447 | 38 |
| 181 | 225 | T369S | 450 | 38 |
| 182 | 226 | T389S | 436 | 31 |
| 607 | 648 | T8L/L44R/Y92H/K206A/F217R/N247D/Q302K/L316D/M322I/A337P/K362Q/E367N/R373K | 398 | 24 |
| 608 | 649 | T8Q/L44R/Y92H/K206A/F217R/N247D/Q302K/L316D/M322I/A337P/K362Q/E367N/R373K | 393 | 24 |
| 183 | 227 | V133I | 457 | 38 |
| 184 | 228 | V168A | 434 | 37 |
| 185 | 229 | V168L | 445 | 38 |
| 186 | 230 | V345N | 447 | 38 |
| 187 | 231 | V345Y | 449 | 38 |
| 188 | 232 | V359E | 429 | 38 |
| 189 | 233 | V93I | 443 | 37 |
| 190 | 234 | W178H | 448 | 38 |
| 191 | 235 | W178S | 442 | 38 |

N.D.—Not determined.

While the invention has been described with reference to the specific embodiments, various changes can be made and equivalents can be substituted to adapt to a particular situation, material, composition of matter, process, process step or steps, thereby achieving benefits of the invention without departing from the scope of what is claimed.

For all purposes in the United States of America, each and every publication and patent document cited in this application is incorporated herein by reference as if each such publication or document was specifically and individually indicated to be incorporated herein by reference. Citation of publications and patent documents is not intended as an indication that any such document is pertinent prior art, nor does it constitute an admission as to its contents or date.

SEQUENCE LISTING (733 sequences)

SEQ ID NO: 1 - DNA, 1290 bp, Artificial Sequence
  Synthetic  Polynucleotide sequence of  full length human GLA cDNA
atgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttag

SEQ ID NO: 2 - protein, 429 aa, Artificial Sequence
  Synthetic  Polypeptide sequence of  full length human GLA
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 3 - DNA, 1194 bp, Artificial Sequence
  Synthetic  Polynucleotide sequence of  mature yeast codon-optimized (yCDS) human GLA
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatggaagtcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 4 - DNA, 1194 bp, Artificial Sequence
  Synthetic  Polynucleotide sequence of  mature human GLA
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 5 - protein, 398 aa, Artificial Sequence
  Synthetic  Polypeptide sequence of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 6 - DNA, 4032 bp, Artificial Sequence
  Synthetic  Polynucleotide sequence of  pCK110900i E. coli expression vector
tcgagttaattaaggcagtgagcgcaacgcaattaatgtgagttagctcactcattaggcaccccaggctttacactttatgcttccggctcgtatgttgtgtggaattgtgagcggataacaatttcacacaggaaacggctatgaccatgattacggattcactggccgtcgttttacaatctagaggccagcctggccataaggagatatacatatgagtattcaacatttccgtgtcgcccttattcccttttctgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagagcgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgtttttttgcacaccatgggggatcatgtaactcgccttgatcgttgggaaccggagctgaatgaagccataccaaacgacgagcgtgacaccacgatgcctacagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgtaatagacagatcgctgagataggtgcctcactgattaagcattggggccaaactggccaccatcaccatcaccattagggaagagcagatgggcaagcttgacctgtgaagtgaaaaatggcgcacattgtgcgacatttttttttgaattctacgtaaaaagccgccgatacatcggctgctttttttttgatagaggttcaaacttgtggtataatgaaataagatcactccggggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggagttccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaactgcaggagctcaaacagcagcctgtattcaggctgcttttttcgttttggtctgcgcgtaatctcttgctctgaaaacgaaaaaaccgccttgcagggcggtttttcgaaggttctctgagctaccaactctttgaaccgaggtaactggcttggaggagcgcagtcaccaaaacttgtcctttcagtttagccttaaccggcgcatgacttcaagactaactcctctaaatcaattaccagtggctgctgccagtggtgcttttgcatgtctttccgggttggactcaagacgatagttaccggataaggcgcagcggtcggactgaacggggggttcgtgcatacagtccagcttggagcgaactgcctacccggaactgagtgtcaggcgtggaatgagacaaacgcggccataacagcggaatgacaccggtaaaccgaaaggcaggaacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtagcgagtcagtgagcgaggaagcggaatatatcctgtatcacatattctgctgacgcaccggtgcagccttttttctcctgccacatgaagcacttcactgacaccctcatcagtgaaccaccgctggtagcggtggtttttttaggcctatggccttttttttttgtgggaaacctttcgcggtatggtattaaagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgtttccactgcgatgctggttgccaacgatcagatggcgctgggcgcaatgcgcgccattaccgagtccgggctgcgcgttggtgcggacatctcggtagtgggatacgacgataccgaagacagctcatgttatatcccgccgttaaccaccatcaaacaggattttcgcctgctggggcaaaccagcgtggaccgcttgctgcaactctctcagggccaggcggttaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcggtacccgataaaagcggcttcctgacaggaggccgttttgtttc

SEQ ID NO: 7 - DNA, 16300 bp, Artificial Sequence
  Synthetic  Polynucleotide sequence of  pCK110900i E. coli expression vector
tttttttttttttttttttttttttttttttttttttttttttttttttttgtacaaatatcataaaaaaagagaatctttttaagcaaggattttcttaacttcttcggcgacagcatcaccgacttcggtggtactgttggaaccacctaaatcaccagttctgatacctgcatccaaaacctttttaactgcatcttcaatggctttaccttcttcaggcaagttcaatgacaatttcaacatcattgcagcagacaagatagtggcgatagggttgaccttattctttggcaaatctggagcggaaccatggcatggttcgtacaaaccaaatgcggtgttcttgtctggcaaagaggccaaggacgcagatggcaacaaacccaaggagcctgggataacggaggcttcatcggagatgatatcaccaaacatgttgctggtgattataataccatttaggtgggttgggttcttaactaggatcatggcggcagaatcaatcaattgatgttgaactttcaatgtagggaattcgttcttgatggtttcctccacagtttttctccataatcttgaagaggccaaaacattagctttatccaaggaccaaataggcaatggtggctcatgttgtagggccatgaaagcggccattcttgtgattctttgcacttctggaacggtgtattgttcactatcccaagcgacaccatcaccatcgtcttcctttctcttaccaaagtaaatacctcccactaattctctaacaacaacgaagtcagtacctttagcaaattgtggcttgattggagataagtctaaaagagagtcggatgcaaagttacatggtcttaagttggcgtacaattgaagttctttacggatttttagtaaaccttgttcaggtctaacactaccggtaccccatttaggaccacccacagcacctaacaaaacggcatcagcctttttggaggcttccagcgcctcatttggaagtggaacacctgtagcatcgatagcagcccccccaattaaatgattttcgaaatcgaacttgacattggaacgaacatcagaaatagctttaagaaccttaatggcttcggctgtgatttcttgaccaacgtggtcacctggcaaaacgacgatttttttaggggcagacattacaatggtatatccttgaaatatatataaaaaaaaaaaaaaaaaaaaaaaaaaaaaaatgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcctcaaaaattcatccaaatatacaagtggatcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgaggatctgggcaaaacgtaggggcaaacaaacggaaaaatcgtttctcaaattttctgatgccaagaactctaaccagtcttatctaaaaattgccttatgatccgtctctccggttacagcctgtgtaactgattaatcctgcctttctaatcaccattctaatgttttaattaagggattttgtcttcattaacggctttcgctcataaaaatgttatgacgttttgcccgcaggcgggaaaccatccacttcacgagactgatctcctctgccggaacaccgggcatctccaacttataagttggagaaataagagaatttcagattgagagaatgaaaaaaaaaaaaaaaaaaaggcagaggagagcatagaaatggggttcactttttggtaaagctatagcatgcctatcacatataaatagagtgccagtagcgacttttttcacactcgaaatactcttactactgctctcttgttgtttttatcacttcttgtttcttcttggtaaatagaatatcaagctacaaaaagcatacaatcaactatcaactattaactatatcgtaatacacaggatccaccatgaaggctgctgcgctttcctgcctcttcggcagtacccttgccgttgcaggcgccattgaatcgagaaaggttcaccagaagcccctcgcgagatctgaacctttttacccgtcgccatggatgaatcccaacgccatcggctgggcggaggcctatgcccaggccaagtcctttgtctcccaaatgactctgctagagaaggtcaacttgaccacgggagtcggctggggggaggagcagtgcgtcggcaacgtgggcgcgatccctcgccttggacttcgcagtctgtgcatgcatgactcccctctcggcgtgcgaggaaccgactacaactcagcgttcccctctggccagaccgttgctgctacctgggatcgcggtctgatgtaccgtcgcggctacgcaatgggccaggaggccaaaggcaagggcatcaatgtccttctcggaccagtcgccggcccccttggccgcatgcccgagggcggtcgtaactgggaaggcttcgctccggatcccgtccttaccggcatcggcatgtccgagacgatcaagggcattcaggatgctggcgtcatcgcttgtgcgaagcactttattggaaacgagcaggagcacttcagacaggtgccagaagcccagggatacggttacaacatcagcgaaaccctctcctccaacattgacgacaagaccatgcacgagctctacctttggccgtttgccgatgccgtccgggccggcgtcggctctgtcatgtgctcgtacaaccagggcaacaactcgtacgcctgccagaactcgaagctgctgaacgacctcctcaagaacgagcttgggtttcagggcttcgtcatgagcgactggtgggcacagcacactggcgcagcaagcgccgtggctggtctcgatatgtccatgccgggcgacaccatggtcaacactggcgtcagtttctggggcgccaatctcaccctcgccgtcctcaacggcacagtccctgcctaccgtctcgacgacatgtgcatgcgcatcatggccgccctcttcaaggtcaccaagaccaccgacctggaaccgatcaacttctccttctggacccgcgacacttatggcccgatccactgggccgccaagcagggctaccaggagattaattcccacgttgacgtccgcgccgaccacggcaacctcatccggaacattgccgccaagggtacggtgctgctgaagaataccggctctctacccctgaacaagccaaagttcgtggccgtcatcggcgaggatgctgggccgagccccaacgggcccaacggctgcagcgaccgcggctgtaacgaaggcacgctcgccatgggctggggatccggcacagccaactatccgtacctcgtttcccccgacgccgcgctccaggcgcgggccatccaggacggcacgaggtacgagagcgtcctgtccaactacgccgaggaaaatacaaaggctctggtctcgcaggccaatgcaaccgccatcgtcttcgtcaatgccgactcaggcgagggctacatcaacgtggacggtaacgagggcgaccgtaagaacctgactctctggaacaacggtgatactctggtcaagaacgtctcgagctggtgcagcaacaccatcgtcgtcatccactcggtcggcccggtcctcctgaccgattggtacgacaaccccaacatcacggccattctctgggctggtcttccgggccaggagtcgggcaactccatcaccgacgtgctttacggcaaggtcaaccccgccgcccgctcgcccttcacttggggcaagacccgcgaaagctatggcgcggacgtcctgtacaagccgaataatggcaattgggcgccccaacaggacttcaccgagggcgtcttcatcgactaccgctacttcgacaaggttgacgatgactcggtcatctacgagttcggccacggcctgagctacaccaccttcgagtacagcaacatccgcgtcgtcaagtccaacgtcagcgagtaccggcccacgacgggcaccacgattcaggccccgacgtttggcaacttctccaccgacctcgaggactatctcttccccaaggacgagttcccctacatcccgcagtacatctacccgtacctcaacacgaccgacccccggagggcctcgggcgatccccactacggccagaccgccgaggagttcctcccgccccacgccaccgatgacgacccccagccgctcctccggtcctcgggcggaaactcccccggcggcaaccgccagctgtacgacattgtctacacaatcacggccgacatcacgaatacgggctccgttgtaggcgaggaggtaccgcagctctacgtctcgctgggcggtcccgaggatcccaaggtgcagctgcgcgactttgacaggatgcggatcgaacccggcgagacgaggcagttcaccggccgcctgacgcgcagagatctgagcaactgggacgtcacggtgcaggactgggtcatcagcaggtatcccaagacggcatatgttgggaggagcagccggaagttggatctcaagattgagcttccttgataagtcgacctcgactttgttcccactgtacttttagctcgtacaaaatacaatatacttttcatttctccgtaaacaacatgttttcccatgtaatatccttttctatttttcgttccgttaccaactttacacatactttatatagctattcacttctatacactaaaaaactaagacaattttaattttgctgcctgccatatttcaatttgttataaattcctataatttatcctattagtagctaaaaaaagatgaatgtgaatcgaatcctaagagaattggatctgatccacaggacgggtgtggtcgccatgatcgcgtagtcgatagtggctccaagtagcgaagcgagcaggactgggcggcggccaaagcggtcggacagtgctccgagaacgggtgcgcatagaaattgcatcaacgcatatagcgctagcagcacgccatagtgactggcgatgctgtcggaatggacgatatcccgcaagaggcccggcagtaccggcataaccaagcctatgcctacagcatccagggtgacggtgccgaggatgacgatgagcgcattgttagatttcatacacggtgcctgactgcgttagcaatttaactgtgataaactaccgcattaaagctttttctttccaattttttttttttcgtcattataaaaatcattacgaccgagattcccgggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcttatcgatcctaccccttgcgctaaagaagtatatgtgcctactaacgcttgtctttgtctctgtcactaaacactggattattactcccagatacttattttggactaatttaaatgatttcggatcaacgttcttaatatcgctgaatcttccacaattgatgaaagtagctaggaagaggaattggtataaagtttttgtttttgtaaatctcgaagtatactcaaacgaatttagtattttctcagtgatctcccagatgctttcaccctcacttagaagtgctttaagcatttttttactgtggctatttcccttatctgcttcttccgatgattcgaactgtaattgcaaactacttacaatatcagtgatatcagattgatgtttttgtccatagtaaggaataattgtaaattcccaagcaggaatcaatttctttaatgaggcttccagaattgttgctttttgcgtcttgtatttaaactggagtgatttattgacaatatcgaaactcagcgaattgcttatgatagtattatagctcatgaatgtggctctcttgattgctgttccgttatgtgtaatcatccaacataaataggttagttcagcagcacataatgctattttctcacctgaaggtctttcaaacctttccacaaactgacgaacaagcaccttaggtggtgttttacataatatatcaaattgtggcatgcttagcgccgatcttgtgtgcaattgatatctagtttcaactactctatttatcttgtatcttgcagtattcaaacacgctaactcgaaaaactaactttaattgtcctgtttgtctcgcgttctttcgaaaaatgcaccggccgcgcattatttgtactgcgaaaataattggtactgcggtatcttcatttcatattttaaaaatgcacctttgctgcttttccttaatttttagacggcccgcaggttcgttttgcggtactatcttgtgataaaaagttgttttgacatgtgatctgcacagattttataatgtaataagcaagaatacattatcaaacgaacaatactggtaaaagaaaaccaaaatggacgacattgaaacagccaagaatctgacggtaaaagcacgtacagcttatagcgtctgggatgtatgtcggctgtttattgaaatgattgctcctgatgtagatattgatatagagagtaaacgtaagtctgatgagctactctttccaggatatgtcataaggcccatggaatctctcacaaccggtaggccgtatggtcttgattctagcgcagaagattccagcgtatcttctgactccagtgctgaggtaattttgcctgctgcgaagatggttaaggaaaggtttgattcgattggaaatggtatgctctcttcacaagaagcaagtcaggctgccatagatttgatgctacagaataacaagctgttagacaatagaaagcaactatacaaatctattgctataataataggaagattgcccgagaaagacaagaagagagctaccgaaatgctcatgagaaaaatggattgtacacagttattagtcccaccagctccaacggaagaagatgttatgaagctcgtaagcgtcgttacccaattgcttactttagttccaccagatcgtcaagctgctttaataggtgatttattcatcccggaatctctaaaggatatattcaatagtttcaatgaactggcggcagagaatcgtttacagcaaaaaaagagtgagttggaaggaaggactgaagtgaaccatgctaatacaaatgaagaagttccctccaggcgaacaagaagtagagacacaaatgcaagaggagcatataaattacaaaacaccatcactgagggccctaaagcggttcccacgaaaaaaaggagagtagcaacgagggtaaggggcagaaaatcacgtaatacttctagggtatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagtatctctttgctatatatctctgtgctatatccctatataacctacccatccacctttcgctccttgaacttgcatctaaactcgacctctacatcaacaggcttccaatgctcttcaaattttactgtcaagtagacccatacggctgtaatatgctgctcttcataatgtaagcttatctttatcgaatcgtgtgaaaaactactaccgcgataaacctttacggttccctgagattgaattagttcctttagtatatgatacaagacacttttgaactttgtacgacgaattttgaggttcgccatcctctggctatttccaattatcctgtcggctattatctccgcctcagtttgatcttccgcttcagactgccatttttcacataatgaatctatttcaccccacaatccttcatccgcctccgcatcttgttccgttaaactattgacttcatgttgtacattgtttagttcacgagaagggtcctcttcaggcggtagctcctgatctcctatatgacctttatcctgttctctttccacaaacttagaaatgtattcatgaattatggagcacctaataacattcttcaaggcggagaagtttgggccagatgcccaatatgcttgacatgaaaacgtgagaatgaatttagtattattgtgatattctgaggcaattttattataatctcgaagataagagaagaatgcagtgacctttgtattgacaaatggagattccatgtatctaaaaaatacgcctttaggccttctgataccctttcccctgcggtttagcgtgccttttacattaatatctaaaccctctccgatggtggcctttaactgactaataaatgcaaccgatataaactgtgataattctgggtgatttatgattcgatcgacaattgtattgtacactagtgcaggatcaggccaatccagttctttttcaattaccggtgtgtcgtctgtattcagtacatgtccaacaaatgcaaatgctaacgttttgtatttcttataattgtcaggaactggaaaagtcccccttgtcgtctcgattacacacctactttcatcgtacaccataggttggaagtgctgcataatacattgcttaatacaagcaagcagtctctcgccattcatatttcagttattttccattacagctgatgtcattgtatatcagcgctgtaaaaatctatctgttacagaaggttttcgcggtttttataaacaaaactttcgttacgaaatcgagcaatcaccccagctgcgtatttggaaattcgggaaaaagtagagcaacgcgagttgcattttttacaccataatgcatgattaacttcgagaagggattaaggctaatttcactagtatgtttcaaaaacctcaatctgtccattgaatgccttataaaacagctatagattgcatagaagagttagctactcaatgctttttgtcaaagcttactgatgatgatgtgtctactttcaggcgggtctgtagtaaggagaatgacattataaagctggcacttagaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgca

SEQ ID NO: 8 - DNA, 1194 bp, Artificial Sequence
  Synthetic  Polynucleotide sequence of  Variant No. 73 yCDS
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 9 - DNA, 1194 bp, Artificial Sequence
  Synthetic  Polynucleotide sequence of  Variant No. 73
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggcgagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 10 - protein, 398 aa, Artificial Sequence
  Synthetic  Polypeptide sequence of  Variant No. 73
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 11 - DNA, 1194 bp, Artificial Sequence
  Synthetic  Polynucleotide sequence of  Variant No. 218 yCDS
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctattatcaaccgtcaagagatcggagggccaagatcttacactatcgcggtagcctctttgggtaagggtgttgcgtgcaatcctgcctgcttcattacacaattgcttccagttaagagaaagttgggtttctataactggacatctaggctaaaaagtcacattaatcctactggtacggtattgttgcaattggagaacacaatgcaaatgtctttgaaagatttgtta

SEQ ID NO: 12 - DNA, 1194 bp, Artificial Sequence
  Synthetic  Polynucleotide sequence of  Variant No. 218 hCDS
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggcgagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctattataaaccggcaggagattggtggacctcgctcttataccatcgcagttgcttccctgggtaaaggagtggcctgtaatcctgcctgcttcatcacacagctcctccctgtgaaaaggaagctagggttctataactggacttcaaggttaaaaagtcacataaatcccacaggcactgttttgcttcagctagaaaatacaatgcagatgtcattaaaagacttactt

SEQ ID NO: 13 - protein, 398 aa, Artificial Sequence
  Synthetic  Polypeptide sequence of  Variant No. 218
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYNWTSRLKSHINPTGTVLLQLENTMQMSLKDLL

SEQ ID NO: 14 - DNA, 1194 bp, Artificial Sequence
  Synthetic  Polynucleotide sequence of  Variant No. 326 yCDS
ttggataacgggttagcccgtacacctactatgggttggcttcactgggaaagattcatgtgtaacttagattgccaagaagagcctgacagctgtatctcagagaaactattcatggagatggctgaacggatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataactggacctctaggctaaaaagtcacattaatcctactggtacggtattgttgcaattggagaacacaatgcaaatgtctttgaaagatttgtta

SEQ ID NO: 15 - protein, 398 aa, Artificial Sequence
  Synthetic  Polypeptide sequence of  Variant No. 326
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 16 - DNA, 1194 bp, Artificial Sequence
  Synthetic  Polynucleotide sequence of  Variant No. 206 yCDS:
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctataattggacctctaggctaagaagtcacatcaatcctactggtacggtattgttgcaattggagaacacaatgcaaatgtctttgaaagatttgtta

SEQ ID NO: 17 - DNA, 1194 bp, Artificial Sequence
  Synthetic  Polynucleotide sequence of  Variant No. 206 hCDS
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggcgagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctataactggacttcaaggttaagaagtcacataaatcccacaggcactgttttgcttcagctagaaaatacaatgcagatgtcattaaaagacttactt

SEQ ID NO: 18 - protein, 398 aa, Artificial Sequence
  Synthetic  Polypeptide sequence of  Variant No. 206
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYNWTSRLRSHINPTGTVLLQLENTMQMSLKDLL

SEQ ID NO: 19 - DNA, 1194 bp, Artificial Sequence
  Synthetic  Polynucleotide sequence of  Variant No. 205 yCDS
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgattgggactctaggctaagaagtcacatcaatcctactggtacggtattgttgcaattggagaacacaatgcaaatgtctttgaaagatttgtta

SEQ ID NO: 20 - DNA, 1194 bp, Artificial Sequence
  Synthetic  Polynucleotide sequence of  Variant No. 205 hCDS
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctgggcgagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgattgggattcaaggttaagaagtcacataaatcccacaggcactgttttgcttcagctagaaaatacaatgcagatgtcattaaaagacttactt

SEQ ID NO: 21 - protein, 398 aa, Artificial Sequence
  Synthetic  Polypeptide sequence of  Variant No. 205
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYDWDSRLRSHINPTGTVLLQLENTMQMSLKDLL

SEQ ID NO: 22 - DNA, 1194 bp, Artificial Sequence
  Synthetic  Polynucleotide sequence of  Variant No. 76 yCDS
ttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatggaggtcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 23 - DNA, 1194 bp, Artificial Sequence
  Synthetic  Polynucleotide sequence of  Variant No. 76 hCDS
ctggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggcgtagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactt

SEQ ID NO: 24 - protein, 398 aa, Artificial Sequence
  Synthetic  Polypeptide sequence of  Variant No. 76
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWRSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 25 - DNA, 57 bp, Artificial Sequence
  Synthetic  Polynucleotide sequence of  Mfalpha signal peptide
atgagatttccttcaatttttactgcagttttattcgcagcatcctccgcattagct

SEQ ID NO: 26 - protein, 19 aa, Artificial Sequence
  Synthetic  Polypeptide sequence of  Mfalpha signal peptide
MRFPSIFTAVLFAASSALA

SEQ ID NO: 27 - DNA, 55 bp, Artificial Sequence
  Synthetic  Polynucleotide sequence of  MMO435
ttaactatatcgtaatacacaggatccaccatgagatttccttcaatttttactg

SEQ ID NO: 28 - DNA, 48 bp, Artificial Sequence
  Synthetic  Polynucleotide sequence of  MMO439
agtaggtgtacgggctaacccgttatccaaagctaatgcggaggatgc

SEQ ID NO: 29 - DNA, 60 bp, Artificial Sequence
  Synthetic  Polynucleotide sequence of  MMO514
ttttactgcagttttattcgcagcatcctccgcattagctttggataacgggttagcccg

SEQ ID NO: 30 - DNA, 60 bp, Artificial Sequence
  Synthetic  Polynucleotide sequence of  MMO481
gagctaaaagtacagtgggaacaaagtcgaggtcgacttataacaaatctttcaaagaca

SEQ ID NO: 31 - DNA, 57 bp, Artificial Sequence
  Synthetic  Polynucleotide sequence of  Synthetic mammalian signal peptide
atggaatggagctgggtctttctcttcttcctgtcagtaacgactggtgtccactcc

SEQ ID NO: 32 - DNA, 20 bp, Artificial Sequence
  Synthetic  Polynucleotide sequence of  LAKE Fw
cgatcgaagcttcgccacca

SEQ ID NO: 33 - DNA, 40 bp, Artificial Sequence
  Synthetic  Polynucleotide sequence of  Br reverse
cttgccaatccattgtccagggagtggacaccagtcgtta

SEQ ID NO: 34 - DNA, 40 bp, Artificial Sequence
  Synthetic  Polynucleotide sequence of  Br Fw
taacgactggtgtccactccctggacaatggattggcaag

SEQ ID NO: 35 - DNA, 37 bp, Artificial Sequence
  Synthetic  Polynucleotide sequence of  hGLA Rv
cgatcggcggccgctcaaagtaagtcttttaatgaca

SEQ ID NO: 36 - DNA, 1251 bp, Artificial Sequence
  Synthetic  Polynucleotide sequence of SP-GLA (yCDS)
atgagatttccttcaatttttactgcagttttattcgcagcatcctccgcattagctttggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatggaagtcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 37 - DNA, 1449 bp, Artificial Sequence
  Synthetic  Polynucleotide Sequence of MFleader-GLA (yCDS)
atgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagattggataacgggttagcccgtacacctactatgggttggcttcactgggaaagattcatgtgtaacttagattgccaagaagagcctgacagctgtatctcagagaaactattcatggagatggctgaactaatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaagggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatggaagtcaatcaaatctatcttggattggacttctttcaaccaggaaagaattgttgatgttgcaggtccaggtggatggaatgaccctgatatgcttgtcatagggaactttgggctatcatggaatcaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagacaaggtgacaactttgaagtgtgggaaagaccattgtctggacttgcgtgggctgttgctatgatcaaccgtcaagagatcggagggccaagatcttacactatcgcggtagcctctttgggtaagggtgttgcgtgcaatcctgcctgcttcattacacaattgcttccagttaagagaaagttgggtttctatgagtggacatctaggctaagaagtcacatcaatcctactggtacggtattgttgcaattggagaacacaatgcaaatgtctttgaaagatttgtta

SEQ ID NO: 38 - protein, 85 aa, Artificial Sequence
  Synthetic  Polypeptide Sequence of MFleader
MRFPSIFTAVLFAASSALAAPVNTTTEDETAQIPAEAVIGYLDLEGDFDVAVLPFSNSTNNGLLFINTTIASIAAKEEGVSLDKR

SEQ ID NO: 39 - DNA, 1194 bp, Artificial Sequence
  Synthetic  Polynucleotide sequence of  Variant No. 395 yCDS
ttggataacgggttagcccgtacacctactatgggttggcttcactgggaaagattcatgtgtaacttagattgccaagaagagcctgacagctgtatctcagagaaactattcatggagatggctgaacggatggtaagtgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggagcatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataactggacctctaggctaaaaagtcacattaatcctactggtacggtattgttgcaattggagaacacaatgcaaatgtctttgaaagatttgtta

SEQ ID NO: 40 - protein, 398 aa, Artificial Sequence
  Synthetic  Polypeptide sequence of  Variant No. 395
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 41 - DNA, 1194 bp, Artificial Sequence
  Synthetic  Polynucleotide sequence of  Variant No. 402 yCDS
ttggataacgggttagcccgtacacctactatgggttggcttcactgggaaagattcatgtgtaacttagattgccaagaagagcctgacagctgtatctcagagaaactattcatggagatggctgaacggatggtaagtgaaggatggaaggatgctggttatgaatacctatgtattgatgattgctggatggctccacagcgtgattcagaaggtaggttacaagctgacccccagagattcccacatggcatacgtcagcttgcaaactacgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccgcacccctattcatgtctaatgatctacgtcacatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataactggacctctaggctaaaaagtcacattaatcctactggtacggtattgttgcaattggagaacacaatgcaaatgtctttgaaagatttgtta

SEQ ID NO: 42 - protein, 398 aa, Artificial Sequence
  Synthetic  Polypeptide sequence of  Variant No. 402
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 43 - DNA, 1194 bp, Artificial Sequence
  Synthetic  Polynucleotide sequence of  Variant No. 625 yCDS
ttggataacgggttagcccgtacacctactatgggttggcttcactgggaaagattcatgtgtaacttagattgccaagaagagcctgacagctgtatctcagagaaactattcatggagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccgcacccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataactggacctctaggctaaaaagtcacattaatcctactggtacggtattgttgcaattggagaacacaatgcaaacctctttgaaagatttgtta

SEQ ID NO: 44 - protein, 398 aa, Artificial Sequence
  Synthetic  Polypeptide sequence of  Variant No. 625
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 45 - DNA, 1194 bp, Artificial Sequence
  Synthetic  Polynucleotide sequence of  Variant No. 648 yCDS
ttggataacgggttagcccgtacacctccgatgggttggcttcactgggaaagattcatgtgtaacttagattgccaagaagagcctgacagctgtatctcagagaaactattcgaagagatggctgaacggatggtaaccgaaggatggaaggatgctggttatgaatacctatgtattgatgattgctggatggctccacagcgtgattcagaaggtaggttacaagctgacccccagagattcccacatggcatacgtcagcttgcaaaccatgtacacagcaaaggtctaaagttaggcatctacgctgatgtcggaaacaagacatgtgctggtttcccaggttcattcggttactatgacatagatgcgcagacgtttgctgattggggtgttgatttgttgaagtttgatggatgctactgcgattccctggagaacctagccgatgggtacaaacacatgagtttggctctaaacaggactggtaggccgatcgtctatagttgtgaatggcccttgtacatgtggccgtttcagaagccaaactacactgagataagacaatactgtaaccattggcgtaactttgctgacatagatgattcatgggcttcaatcaaatctatcttggattggacttctcgtaaccaggaaagaattgttgatgttgcaggtccaggtggatggaatgaccctgatatgcttgtcatagggaactttgggctatcatgggaccaacaagttacacaaatggctttgtgggcgatcatggccggccccctattcatgtctaatgatctacgtgcgatatcaccccaagcaaaggctttacttcaagataaggatgtcatagcgatcaaccaagatcctcttggtaaacaaggttatcaattgagaaaaggtgacaactttgaagtgtgggaaagaccattgtctggagatgcgtgggctgttgctattatcaaccgtcaagagatcggagggccaagatcttacactatcccggtagcctctttgggtaagggtgttgcgtgcaatcctgcctgcttcattacacaattgcttccagttaagagacaattgggtttctataacgcaacctctaggctaaaaagtcacattaatcctactggtacggtattgttgcaattggagaacacaatgcaaacctctttgaaagatttgtta

SEQ ID NO: 46 - protein, 398 aa, Artificial Sequence
  Synthetic  Polypeptide sequence of  Variant No. 648
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 47 - protein, 398 aa, Artificial Sequence
  Synthetic Polypeptide sequence of  Variant No.  1 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTISVASLGKGVACNPACFITQLLPVKRKLGFYEWTSRLRSHINPTGTVLLQLENTMQMSLKDLL

SEQ ID NO: 48 - protein, 398 aa, Artificial Sequence
  Synthetic Polypeptide sequence of  Variant No.  2 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 49 - protein, 398 aa, Artificial Sequence
  Synthetic Polypeptide sequence of  Variant No.  3 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 50 - protein, 398 aa, Artificial Sequence
  Synthetic Polypeptide sequence of  Variant No.  4 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 51 - protein, 398 aa, Artificial Sequence
  Synthetic Polypeptide sequence of  Variant No.  5 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHINPTGTVLLQLENTMQMSLKDLL

SEQ ID NO: 52 - protein, 398 aa, Artificial Sequence
  Synthetic Polypeptide sequence of  Variant No.  6 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 53 - protein, 398 aa, Artificial Sequence
  Synthetic Polypeptide sequence of  Variant No.  7 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 54 - protein, 398 aa, Artificial Sequence
  Synthetic Polypeptide sequence of  Variant No.  8 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLKSHINPTGTVLLQLENTMQMSLKDLL

SEQ ID NO: 55 - protein, 398 aa, Artificial Sequence
  Synthetic Polypeptide sequence of  Variant No.  9 of  mature Human GLA
LDNGLARTPTMGWLHWERFMCNLDCQEEPDSCISEKLFMEMADLMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 56 - protein, 398 aa, Artificial Sequence
  Synthetic Polypeptide sequence of  Variant No.  10 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 57 - protein, 398 aa, Artificial Sequence
  Synthetic Polypeptide sequence of  Variant No.  11 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYRLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 58 - protein, 398 aa, Artificial Sequence
  Synthetic Polypeptide sequence of  Variant No.  12 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYRLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 59 - protein, 398 aa, Artificial Sequence
  Synthetic Polypeptide sequence of  Variant No.  13 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 60 - protein, 398 aa, Artificial Sequence
  Synthetic Polypeptide sequence of  Variant No.  14 of  mature Human GLA
LDNGLARTPTMGWLHWERFMCNLDCQEEPDSCISEKLFMEMADLMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 61 - protein, 398 aa, Artificial Sequence
  Synthetic Polypeptide sequence of  Variant No.  15 of  mature Human GLA
LDNGLARTPTMGWLHWERFMCNLDCQEEPDSCISEKLFMEMAELMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHINPTGTVLLQLENTMQMSLKDLL

SEQ ID NO: 62 - protein, 399 aa, Artificial Sequence
  Synthetic Polypeptide sequence of  Variant No.  16 of  mature Human GLA
LDNGLARTPTMGWLHWERFMCNLDCQEEPDSCISEKLFMEMAELMVSDGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 63 - protein, 399 aa, Artificial Sequence
  Synthetic Polypeptide sequence of  Variant No.  17 of  mature Human GLA
LDNGLARTPTMGWLHWERFMCNLDCQEEPDSCISEKLFMEMAELMVSGGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHINPTGTVLLQLENTMQMSLKDLLL

SEQ ID NO: 64 - protein, 399 aa, Artificial Sequence
  Synthetic Polypeptide sequence of  Variant No.  18 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSSNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLLL

SEQ ID NO: 65 - protein, 399 aa, Artificial Sequence
  Synthetic Polypeptide sequence of  Variant No.  19 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 66 - protein, 399 aa, Artificial Sequence
  Synthetic Polypeptide sequence of  Variant No.  20 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYRLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 67 - protein, 399 aa, Artificial Sequence
  Synthetic Polypeptide sequence of  Variant No.  21 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 68 - protein, 399 aa, Artificial Sequence
  Synthetic Polypeptide sequence of  Variant No.  22 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYRLRQGDNFEVWERPLSGLAWAVAMINRQEIGGPRSYTIAVASLGKGVACNPACFITQLLPVKRKLGFYEWTSRLRSHVNPTGTVLLQLENTMQMSLKDLLL

SEQ ID NO: 69 - protein, 399 aa, Artificial Sequence
  Synthetic Polypeptide sequence of  Variant No.  23 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSVKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 70 - protein, 399 aa, Artificial Sequence
  Synthetic Polypeptide sequence of  Variant No.  24 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHVNPTGTVLLQLENTMQMSLKDLLL

SEQ ID NO: 71 - protein, 399 aa, Artificial Sequence
  Synthetic Polypeptide sequence of  Variant No.  25 of  mature Human GLA
LDNGLARTPTMGWLHWERFMCNLDCQEEPDSCISEQLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLLL

SEQ ID NO: 72 - protein, 399 aa, Artificial Sequence
  Synthetic Polypeptide sequence of  Variant No.  26 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWSFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHINPTGTVLLQLENTMQMSLKDLLL

SEQ ID NO: 73 - protein, 399 aa, Artificial Sequence
  Synthetic Polypeptide sequence of  Variant No.  27 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYRLRQGDNFEVWERPLSGLAWAVAVINRQEIGGPRSYTIAVASLGKGVACNPACFITQLLPVKRKLGFYEWTSRLKSHINPTGTVLLQLENTMQMSLKDLLL

SEQ ID NO: 74 - protein, 399 aa, Artificial Sequence
  Synthetic Polypeptide sequence of  Variant No.  28 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHINPTGTVLLQLENTMQMSLKDLLL

SEQ ID NO: 75 - protein, 399 aa, Artificial Sequence
  Synthetic Polypeptide sequence of  Variant No.  29 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYRLRKGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 76 - protein, 399 aa, Artificial Sequence
  Synthetic Polypeptide sequence of  Variant No.  30 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHVNPTGTVLLQLENTMQMSLKDLLL

SEQ ID NO: 77 - protein, 399 aa, Artificial Sequence
  Synthetic Polypeptide sequence of  Variant No.  31 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHINPTGTVLLQLENTMQMSLKDLLL

SEQ ID NO: 78 - protein, 399 aa, Artificial Sequence
  Synthetic Polypeptide sequence of  Variant No.  32 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLLL

SEQ ID NO: 79 - protein, 398 aa, Artificial Sequence
  Synthetic Polypeptide sequence of  Variant No.  33 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFHDIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYSWTSRLRSHINPTGTVLLQLENTMQMSKDLLL

SEQ ID NO: 80 - protein, 398 aa, Artificial Sequence
  Synthetic Polypeptide sequence of  Variant No.  34 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQMSKDLLL

SEQ ID NO: 81 - protein, 398 aa, Artificial Sequence
  Synthetic Polypeptide sequence of  Variant No.  35 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVSSLGKGVACNPACFITQLLPVKRKLGFYEWTSRLRSHINPTGTVLLQLENTMQMSKDLLL

SEQ ID NO: 82 - protein, 398 aa, Artificial Sequence
  Synthetic Polypeptide sequence of  Variant No.  36 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWTSRLRSHINPTGTVLLQLENTMQMSKDLLL

SEQ ID NO: 83 - protein, 398 aa, Artificial Sequence
  Synthetic Polypeptide sequence of  Variant No.  37 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYAAVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 84 - protein, 398 aa, Artificial Sequence
  Synthetic Polypeptide sequence of  Variant No.  38 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYASVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 85 - protein, 398 aa, Artificial Sequence
  Synthetic Polypeptide sequence of  Variant No.  39 of  mature Human GLA
  VARIANT (170)..(170): Xaa = any amino acid or absent
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDINAQTFADWGVDLLKFDGCYCDSLGNLADGYKHMSLALKQVGASSIVXCEWPLYSWPFQKPNYTEIRQYCNHWRNFADIDDSWKSIKSILDWTSENQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 86 - protein, 398 aa, Artificial Sequence
  Synthetic Polypeptide sequence of  Variant No.  40 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDRLL

SEQ ID NO: 87 - protein, 398 aa, Artificial Sequence
  Synthetic Polypeptide sequence of  Variant No.  41 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDTLL

SEQ ID NO: 88 - protein, 398 aa, Artificial Sequence
  Synthetic Polypeptide sequence of  Variant No.  42 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYNWTSRLRSHINPTGTVLLQLENTMQMSKDLLL

SEQ ID NO: 89 - protein, 398 aa, Artificial Sequence
  Synthetic Polypeptide sequence of  Variant No.  43 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYTWTSRLRSHINPTGTVLLQLENTMQMSKDLLL

SEQ ID NO: 90 - protein, 398 aa, Artificial Sequence
  Synthetic Polypeptide sequence of  Variant No.  44 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLKNTMQMSKDLLL

SEQ ID NO: 91 - protein, 398 aa, Artificial Sequence
  Synthetic Polypeptide sequence of  Variant No.  45 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLQNTMQMSKDLLL

SEQ ID NO: 92 - protein, 398 aa, Artificial Sequence
  Synthetic Polypeptide sequence of  Variant No.  46 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLRNTMQMSKDLLL

SEQ ID NO: 93 - protein, 398 aa, Artificial Sequence
  Synthetic Polypeptide sequence of  Variant No.  47 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLTNTMQMSKDLLL

SEQ ID NO: 94 - protein, 398 aa, Artificial Sequence
  Synthetic Polypeptide sequence of  Variant No.  48 of  mature Human GLA
LDNGLARTPTMGWLHWERFMCNLDCQEEPDSCISEKLFMDMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 95 - protein, 398 aa, Artificial Sequence
  Synthetic Polypeptide sequence of  Variant No.  49 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPRQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 96 - protein, 398 aa, Artificial Sequence
  Synthetic Polypeptide sequence of  Variant No.  50 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPSQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 97 - protein, 398 aa, Artificial Sequence
  Synthetic Polypeptide sequence of  Variant No.  51 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNSADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 98 - protein, 398 aa, Artificial Sequence
  Synthetic Polypeptide sequence of  Variant No.  52 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSDNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 99 - protein, 398 aa, Artificial Sequence
  Synthetic Polypeptide sequence of  Variant No.  53 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 100 - protein, 398 aa, Artificial Sequence
  Synthetic Polypeptide sequence of  Variant No.  54 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACIITQLLPVKRKLGFYEWTSRLRSHINPTGTVLLQLENTMQMSKDLLL

SEQ ID NO: 101 - protein, 398 aa, Artificial Sequence
  Synthetic Polypeptide sequence of  Variant No.  55 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACVITQLLPVKRKLGIYEWTSRLRSHINPTGTVLLQLENTMQMSKDLLL

SEQ ID NO: 102 - protein, 398 aa, Artificial Sequence
  Synthetic Polypeptide sequence of  Variant No.  56 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGIYEWTSRLRSHINPTGTVLLQLENTMQMSKDLLL

SEQ ID NO: 103 - protein, 398 aa, Artificial Sequence
  Synthetic Polypeptide sequence of  Variant No.  57 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGKYEWTSRLRSHINPTGTVLLQLENTMQMSKDLLL

SEQ ID NO: 104 - protein, 398 aa, Artificial Sequence
  Synthetic Polypeptide sequence of  Variant No.  58 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYEWTSRLRSHINPTGTVLLQLENTMQMSKDLLL

SEQ ID NO: 105 - protein, 398 aa, Artificial Sequence
  Synthetic Polypeptide sequence of  Variant No.  59 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGRYEWTSRLRSHINPTGTVLLQLENTMQMSKDLLL

SEQ ID NO: 106 - protein, 398 aa, Artificial Sequence
  Synthetic Polypeptide sequence of  Variant No.  60 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGTYEWTSRLRSHINPTGTVLLQLENTMQMSKDLLL

SEQ ID NO: 107 - protein, 398 aa, Artificial Sequence
  Synthetic Polypeptide sequence of  Variant No.  61 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGVYEWTSRLRSHINPTGTVLLQLENTMQMSKDLLL

SEQ ID NO: 108 - protein, 398 aa, Artificial Sequence
  Synthetic Polypeptide sequence of  Variant No.  62 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQQDNFEVWERPLSGLAWAVAMINRQEIGGPRSYTIAVASLGKGVACNPACFITQLLPVKRKLGFYEWTSRLVSHINPTGTVLLQLENTMQMSKDLLL

SEQ ID NO: 109 - protein, 398 aa, Artificial Sequence
  Synthetic Polypeptide sequence of  Variant No.  63 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKAMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 110 - protein, 398 aa, Artificial Sequence
  Synthetic Polypeptide sequence of  Variant No.  64 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKLMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 111 - protein, 398 aa, Artificial Sequence
  Synthetic Polypeptide sequence of  Variant No.  65 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKRMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 112 - protein, 398 aa, Artificial Sequence
  Synthetic Polypeptide sequence of  Variant No.  66 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKTMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 113 - protein, 398 aa, Artificial Sequence
  Synthetic Polypeptide sequence of  Variant No.  67 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKEMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 114 - protein, 398 aa, Artificial Sequence
  Synthetic Polypeptide sequence of  Variant No.  68 of  mature Human GLA
LDNGLARTPTMGWLHWERFMCNLDCQEEPDSCISEKLFMEMAELMVSEGWKDAGYEYLCIDDCWMAPQRDSEGRLQADPQRFPSGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 115 - protein, 398 aa, Artificial Sequence
  Synthetic Polypeptide sequence of  Variant No.  69 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGLYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 116 - protein, 398 aa, Artificial Sequence
  Synthetic Polypeptide sequence of  Variant No.  70 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGLYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSVDLLL

SEQ ID NO: 117 - protein, 398 aa, Artificial Sequence
  Synthetic Polypeptide sequence of  Variant No.  71 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDTDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWNSRLRSHINPTGTVLLQLENTMQMSKDLLL

SEQ ID NO: 118 - protein, 398 aa, Artificial Sequence
  Synthetic Polypeptide sequence of  Variant No.  72 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSVVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 119 - protein, 398 aa, Artificial Sequence
  Synthetic Polypeptide sequence of  Variant No. 74 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWMSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 120 - protein, 398 aa, Artificial Sequence
  Synthetic Polypeptide sequence of  Variant No. 75 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWQSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 121 - protein, 398 aa, Artificial Sequence
  Synthetic Polypeptide sequence of  Variant No. 77 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWTSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPSKRKLGFYEWTSRLRSHINPTGTVLLQLENTMQMSKDLLL

SEQ ID NO: 122 - protein, 398 aa, Artificial Sequence
  Synthetic Polypeptide sequence of  Variant No. 78 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGDGVACNPACFITQLLPVKRKLGFYEWTSRLRSHINPTGTVLLQLENTMQMSKDLLL

SEQ ID NO: 123 - protein, 398 aa, Artificial Sequence
  Synthetic Polypeptide sequence of  Variant No. 79 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGGGVACNPACFITQLLPVKRKLGFYEWTSRLRSHINPTGTVLLQLENTMQMSKDLLL

SEQ ID NO: 124 - protein, 398 aa, Artificial Sequence
  Synthetic Polypeptide sequence of  Variant No. 80 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRQLGFYEWTSRLRSHINPTGTVLLQLENTMQMSKDLLL

SEQ ID NO: 125 - protein, 398 aa, Artificial Sequence
  Synthetic Polypeptide sequence of  Variant No. 81 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRRLGFYEWTSRLRSHINPTGTVLLQLENTMQMSKDLLL

SEQ ID NO: 126 - protein, 398 aa, Artificial Sequence
  Synthetic Polypeptide sequence of  Variant No. 82 of  mature Human GLA
LDNGLARTPTMGWLHWERFMCNLDCQEEPDSCISEDLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 127 - protein, 398 aa, Artificial Sequence
  Synthetic Polypeptide sequence of  Variant No. 83 of  mature Human GLA
LDNGLARTPTMGWLHWERFMCNLDCQEEPDSCISEELFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 128 - protein, 398 aa, Artificial Sequence
  Synthetic Polypeptide sequence of  Variant No. 84 of  mature Human GLA
  VARIANT (395)..(395): Xaa = any amino acid
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKXLLL

SEQ ID NO: 129 - protein, 398 aa, Artificial Sequence
  Synthetic Polypeptide sequence of  Variant No. 85 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKGLLL

SEQ ID NO: 130 - protein, 398 aa, Artificial Sequence
  Synthetic Polypeptide sequence of  Variant No. 86 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKPLLL

SEQ ID NO: 131 - protein, 398 aa, Artificial Sequence
  Synthetic Polypeptide sequence of  Variant No. 87 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKRLLL

SEQ ID NO: 132 - protein, 398 aa, Artificial Sequence
  Synthetic Polypeptide sequence of  Variant No. 88 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKSLLL

SEQ ID NO: 133 - protein, 398 aa, Artificial Sequence
  Synthetic Polypeptide sequence of  Variant No. 89 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKTLLL

SEQ ID NO: 134 - protein, 398 aa, Artificial Sequence
  Synthetic Polypeptide sequence of  Variant No. 90 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 135 - protein, 398 aa, Artificial Sequence
  Synthetic Polypeptide sequence of  Variant No. 91 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSLGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 136 - protein, 398 aa, Artificial Sequence
  Synthetic Polypeptide sequence of  Variant No. 92 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSRGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 137 - protein, 398 aa, Artificial Sequence
  Synthetic Polypeptide sequence of  Variant No. 93 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSRGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLVL

SEQ ID NO: 138 - protein, 398 aa, Artificial Sequence
  Synthetic Polypeptide sequence of  Variant No. 94 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 139 - protein, 398 aa, Artificial Sequence
  Synthetic Polypeptide sequence of  Variant No. 95 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSAALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 140 - protein, 398 aa, Artificial Sequence
  Synthetic Polypeptide sequence of  Variant No. 96 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSIALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 141 - protein, 398 aa, Artificial Sequence
  Synthetic Polypeptide sequence of  Variant No. 97 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSMALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 142 - protein, 398 aa, Artificial Sequence
  Synthetic Polypeptide sequence of  Variant No. 98 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSRALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 143 - protein, 398 aa, Artificial Sequence
  Synthetic Polypeptide sequence of  Variant No. 99  of  mature Human GLA
LDNGLARTPTMGWLHWERFMCNMDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 144 - protein, 398 aa, Artificial Sequence
  Synthetic Polypeptide sequence of  Variant No. 100 of  mature Human GLA
LDNGLARTPTMGWLHWERFMCNTDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 145 - protein, 398 aa, Artificial Sequence
  Synthetic Polypeptide sequence of  Variant No. 101 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSKDLLL

SEQ ID NO: 146 - protein, 398 aa, Artificial Sequence
  Synthetic Polypeptide sequence of  Variant No. 102 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGEAWAVAMINRQEIGGPRSYTIAVASLGKGVACNPACFITQLLPVKRKLGFYEWTSRLRSHINPTGTVLLQLENTMQMSKDLLL

SEQ ID NO: 147 - protein, 398 aa, Artificial Sequence
  Synthetic Polypeptide sequence of  Variant No. 103 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLFQLENTMQMSKDLLL

SEQ ID NO: 148 - protein, 398 aa, Artificial Sequence
  Synthetic Polypeptide sequence of  Variant No. 104 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQVENTMQMSKDLLL

SEQ ID NO: 149 - protein, 398 aa, Artificial Sequence
  Synthetic Polypeptide sequence of  Variant No. 105 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSADLLL

SEQ ID NO: 150 - protein, 398 aa, Artificial Sequence
  Synthetic Polypeptide sequence of  Variant No. 106 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSRDLLL

SEQ ID NO: 151 - protein, 398 aa, Artificial Sequence
  Synthetic Polypeptide sequence of  Variant No. 107 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSSDLLL

SEQ ID NO: 152 - protein, 398 aa, Artificial Sequence
  Synthetic Polypeptide sequence of  Variant No. 108 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSTDLLL

SEQ ID NO: 153 - protein, 398 aa, Artificial Sequence
  Synthetic Polypeptide sequence of  Variant No. 109 of  mature Human GLA
  VARIANT (397)..(397): Xaa = any amino acid
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLXL

SEQ ID NO: 154 - protein, 398 aa, Artificial Sequence
  Synthetic Polypeptide sequence of  Variant No. 110 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLDL

SEQ ID NO: 155 - protein, 398 aa, Artificial Sequence
  Synthetic Polypeptide sequence of  Variant No. 111 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLHL

SEQ ID NO: 156 - protein, 398 aa, Artificial Sequence
  Synthetic Polypeptide sequence of  Variant No. 112 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLIL

SEQ ID NO: 157 - protein, 398 aa, Artificial Sequence
  Synthetic Polypeptide sequence of  Variant No. 113 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLQL

SEQ ID NO: 158 - protein, 398 aa, Artificial Sequence
  Synthetic Polypeptide sequence of  Variant No. 114 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLRL

SEQ ID NO: 159 - protein, 398 aa, Artificial Sequence
  Synthetic Polypeptide sequence of  Variant No. 115 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLTL

SEQ ID NO: 160 - protein, 398 aa, Artificial Sequence
  Synthetic Polypeptide sequence of  Variant No. 116 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLE

SEQ ID NO: 161 - protein, 398 aa, Artificial Sequence
  Synthetic Polypeptide sequence of  Variant No. 117 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLG

SEQ ID NO: 162 - protein, 398 aa, Artificial Sequence
  Synthetic Polypeptide sequence of  Variant No. 118 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLN

SEQ ID NO: 163 - protein, 398 aa, Artificial Sequence
  Synthetic Polypeptide sequence of  Variant No. 119 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLQ

SEQ ID NO: 164 - protein, 398 aa, Artificial Sequence
  Synthetic Polypeptide sequence of  Variant No. 120 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLR

SEQ ID NO: 165 - protein, 398 aa, Artificial Sequence
  Synthetic Polypeptide sequence of  Variant No. 121 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLFQLENTMQMSKDLLL

SEQ ID NO: 166 - protein, 398 aa, Artificial Sequence
  Synthetic Polypeptide sequence of  Variant No. 122 of  mature Human GLA
LDNGLARTPTMGWLHWERFMCNLDCQEEPDSCISEKLFMEMAETMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 167 - protein, 398 aa, Artificial Sequence
  Synthetic Polypeptide sequence of  Variant No. 123 of  mature Human GLA
LDNGLARTPTMGWLHWERFDCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 168 - protein, 398 aa, Artificial Sequence
  Synthetic Polypeptide sequence of  Variant No. 124 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQFALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 169 - protein, 398 aa, Artificial Sequence
  Synthetic Polypeptide sequence of  Variant No. 125 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLRSHINPTGTVLLQLENTMQMSKDLLL

SEQ ID NO: 170 - protein, 398 aa, Artificial Sequence
  Synthetic Polypeptide sequence of  Variant No. 126 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTDQMSKDLLL

SEQ ID NO: 171 - protein, 398 aa, Artificial Sequence
  Synthetic Polypeptide sequence of  Variant No. 127 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTRQMSKDLLL

SEQ ID NO: 172 - protein, 398 aa, Artificial Sequence
  Synthetic Polypeptide sequence of  Variant No. 128 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTTQMSKDLLL

SEQ ID NO: 173 - protein, 398 aa, Artificial Sequence
  Synthetic Polypeptide sequence of  Variant No. 129 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQGSKDLLL

SEQ ID NO: 174 - protein, 398 aa, Artificial Sequence
  Synthetic Polypeptide sequence of  Variant No. 130 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQPSKDLLL

SEQ ID NO: 175 - protein, 398 aa, Artificial Sequence
  Synthetic Polypeptide sequence of  Variant No. 131 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQSSKDLLL

SEQ ID NO: 176 - protein, 398 aa, Artificial Sequence
  Synthetic Polypeptide sequence of  Variant No. 132 of  mature Human GLA
LDNGLARTPTMGWLHWERFMCNLDCQEEPDSCISEKLFYEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 177 - protein, 398 aa, Artificial Sequence
  Synthetic Polypeptide sequence of  Variant No. 133 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLERTMQMSKDLLL

SEQ ID NO: 178 - protein, 398 aa, Artificial Sequence
  Synthetic Polypeptide sequence of  Variant No. 134 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLAQYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 179 - protein, 398 aa, Artificial Sequence
  Synthetic Polypeptide sequence of  Variant No. 135 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRSYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWDSRLRSHINPTGTVLLQLENTMQMSKDLLL

SEQ ID NO: 180 - protein, 398 aa, Artificial Sequence
  Synthetic Polypeptide sequence of  Variant No. 136 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQAVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 181 - protein, 398 aa, Artificial Sequence
  Synthetic Polypeptide sequence of  Variant No. 13 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRAGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 182 - protein, 398 aa, Artificial Sequence
  Synthetic Polypeptide sequence of  Variant No. 138 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLHLENTMQMSKDLLL

SEQ ID NO: 183 - protein, 398 aa, Artificial Sequence
  Synthetic Polypeptide sequence of  Variant No. 139 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLILENTMQMSKDLLL

SEQ ID NO: 184 - protein, 398 aa, Artificial Sequence
  Synthetic Polypeptide sequence of  Variant No. 140 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLLLENTMQMSKDLLL

SEQ ID NO: 185 - protein, 398 aa, Artificial Sequence
  Synthetic Polypeptide sequence of  Variant No. 141 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMGMSKDLLL

SEQ ID NO: 186 - protein, 398 aa, Artificial Sequence
  Synthetic Polypeptide sequence of  Variant No. 142 of  mature Human GLA
LDNGLARTPTMGWLHWERFMCNLDCQEEPDSCISEKLFMEMAELMVSEGWKDAGYEYLCIDDCWMAPQRDSEGRLQADPARFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 187 - protein, 398 aa, Artificial Sequence
  Synthetic Polypeptide sequence of  Variant No. 143 of  mature Human GLA
LDNGLARTPTMGWLHWERFMCNLDCQEEPDSCISEKLFMEMAELMVSEGWKDAGYEYLCIDDCWMAPQRDSEGRLQADPHRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 188 - protein, 398 aa, Artificial Sequence
  Synthetic Polypeptide sequence of  Variant No. 144 of  mature Human GLA
LDNGLARTPTMGWLHWERFMCNLDCQEEPDSCISEKLFMEMAELMVSEGWKDAGYEYLCIDDCWMAPQRDSEGRLQADPVRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 189 - protein, 398 aa, Artificial Sequence
  Synthetic Polypeptide sequence of  Variant No. 145 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRALANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 190 - protein, 398 aa, Artificial Sequence
  Synthetic Polypeptide sequence of  Variant No. 146 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRFLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 191 - protein, 398 aa, Artificial Sequence
  Synthetic Polypeptide sequence of  Variant No. 147 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRHLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 192 - protein, 398 aa, Artificial Sequence
  Synthetic Polypeptide sequence of  Variant No. 148 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRRLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 193 - protein, 398 aa, Artificial Sequence
  Synthetic Polypeptide sequence of  Variant No. 149 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRSLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 194 - protein, 398 aa, Artificial Sequence
  Synthetic Polypeptide sequence of  Variant No. 150 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNHTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 195 - protein, 398 aa, Artificial Sequence
  Synthetic Polypeptide sequence of  Variant No. 151 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNSTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 196 - protein, 398 aa, Artificial Sequence
  Synthetic Polypeptide sequence of  Variant No. 152 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWTSRLRSHINPTGTVLLQLENTMQMSKDLLL

SEQ ID NO: 197 - protein, 398 aa, Artificial Sequence
  Synthetic Polypeptide sequence of  Variant No. 153 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 198 - protein, 398 aa, Artificial Sequence
  Synthetic Polypeptide sequence of  Variant No. 154 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLIQGDNFEVWERPLSGLAWAVAMINRQEIGGPRSYTIAVASLGKGVACNPACFITQLLPVKRTLGFYEWTSRLRSHINPTGTVLLQLENTMQMSKDLLL

SEQ ID NO: 199 - protein, 398 aa, Artificial Sequence
  Synthetic Polypeptide sequence of  Variant No. 155 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLLQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 200 - protein, 398 aa, Artificial Sequence
  Synthetic Polypeptide sequence of  Variant No. 156 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSSLRSHINPTGTVLLQLENTMQMSKDLLL

SEQ ID NO: 201 - protein, 398 aa, Artificial Sequence
  Synthetic Polypeptide sequence of  Variant No. 157 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSVLRSHINPTGTVLLQLENTMQMSKDLLL

SEQ ID NO: 202 - protein, 398 aa, Artificial Sequence
  Synthetic Polypeptide sequence of  Variant No. 158 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIKQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 203 - protein, 398 aa, Artificial Sequence
  Synthetic Polypeptide sequence of  Variant No. 159 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIPQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLR

SEQ ID NO: 204 - protein, 398 aa, Artificial Sequence
  Synthetic Polypeptide sequence of  Variant No. 160 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRAIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 205 - protein, 398 aa, Artificial Sequence
  Synthetic Polypeptide sequence of  Variant No. 161 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRHIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 206 - protein, 398 aa, Artificial Sequence
  Synthetic Polypeptide sequence of  Variant No. 162 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRKIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 207 - protein, 398 aa, Artificial Sequence
  Synthetic Polypeptide sequence of  Variant No. 163 of  mature Human GLA
LDNGLARTPTMGWLHWERFMCNLDCQEEPDDCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 208 - protein, 398 aa, Artificial Sequence
  Synthetic Polypeptide sequence of  Variant No. 164 of  mature Human GLA
LDNGLARTPTMGWLHWERFMCNLDCQEEPDSCIDEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQPSKDLLL

SEQ ID NO: 209 - protein, 398 aa, Artificial Sequence
  Synthetic Polypeptide sequence of  Variant No. 165 of  mature Human GLA
LDNGLARTPTMGWLHWERFMCNLDCQEEPDSCIGEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 210 - protein, 398 aa, Artificial Sequence
  Synthetic Polypeptide sequence of  Variant No. 166 of  mature Human GLA
LDNGLARTPTMGWLHWERFMCNLDCQEEPDSCIHEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTRQMSKDLLL

SEQ ID NO: 211 - protein, 398 aa, Artificial Sequence
  Synthetic Polypeptide sequence of  Variant No. 16 of  mature Human GLA
LDNGLARTPTMGWLHWERFMCNLDCQEEPDSCIREKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 212 - protein, 398 aa, Artificial Sequence
  Synthetic Polypeptide sequence of  Variant No. 168 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRMHINPTGTVLLQLENTMQMSKDLLL

SEQ ID NO: 213 - protein, 398 aa, Artificial Sequence
  Synthetic Polypeptide sequence of  Variant No. 169 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRTHINPTGTVLLQLENTMQMSKDLLL

SEQ ID NO: 214 - protein, 398 aa, Artificial Sequence
  Synthetic Polypeptide sequence of  Variant No. 170 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMEKDLLL

SEQ ID NO: 215 - protein, 398 aa, Artificial Sequence
  Synthetic Polypeptide sequence of  Variant No. 171 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMGKDLLL

SEQ ID NO: 216 - protein, 398 aa, Artificial Sequence
  Synthetic Polypeptide sequence of  Variant No. 172 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMHKDLLL

SEQ ID NO: 217 - protein, 398 aa, Artificial Sequence
  Synthetic Polypeptide sequence of  Variant No. 173 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMPKDLLL

SEQ ID NO: 218 - protein, 398 aa, Artificial Sequence
  Synthetic Polypeptide sequence of  Variant No. 174 of  mature Human GLA
LDNGLARTPTMGWLHWERFMCNLDCQEEPDSCISEKLFMEMAELMVIEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 219 - protein, 398 aa, Artificial Sequence
  Synthetic Polypeptide sequence of  Variant No. 175 of  mature Human GLA
LDNGLARTPTMGWLHWERFMCNLDCQEEPDSCISEKLFMEMAELMVREGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 220 - protein, 398 aa, Artificial Sequence
  Synthetic Polypeptide sequence of  Variant No. 176 of  mature Human GLA
LDNGLARTPTMGWLHWERFMCNLDCQEEPDSCISEKLFMEMAELMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 221 - protein, 398 aa, Artificial Sequence
  Synthetic Polypeptide sequence of  Variant No. 177  of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHDKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 222 - protein, 398 aa, Artificial Sequence
  Synthetic Polypeptide sequence of  Variant No. 178 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHEKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 223 - protein, 398 aa, Artificial Sequence
  Synthetic Polypeptide sequence of  Variant No. 179 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHQKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 224 - protein, 398 aa, Artificial Sequence
  Synthetic Polypeptide sequence of  Variant No. 180 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWDSRLRSHINPTGTVLLQLENTMQMSKDLLL

SEQ ID NO: 225 - protein, 398 aa, Artificial Sequence
  Synthetic Polypeptide sequence of  Variant No. 181 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWSSRLRSHINPTGTVLLQLENTMQMSKDLLL

SEQ ID NO: 226 - protein, 398 aa, Artificial Sequence
  Synthetic Polypeptide sequence of  Variant No. 182 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENSMQMSKDLLL

SEQ ID NO: 227 - protein, 398 aa, Artificial Sequence
  Synthetic Polypeptide sequence of  Variant No. 183 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGIDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 228 - protein, 398 aa, Artificial Sequence
  Synthetic Polypeptide sequence of  Variant No. 184 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIAYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 229 - protein, 398 aa, Artificial Sequence
  Synthetic Polypeptide sequence of  Variant No. 185 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSILYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 230 - protein, 398 aa, Artificial Sequence
  Synthetic Polypeptide sequence of  Variant No. 186 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGNACNPACFITQLLPVKRKLGFYEWTSRLRSHINPTGTVLLQLENTMQMSKDLLL

SEQ ID NO: 231 - protein, 398 aa, Artificial Sequence
  Synthetic Polypeptide sequence of  Variant No. 187 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGYACNPACFITQLLPVKRKLGFYEWTSRLRSHINPTGTVLLQLENTMQMSKDLLL

SEQ ID NO: 232 - protein, 398 aa, Artificial Sequence
  Synthetic Polypeptide sequence of  Variant No. 188 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPEKRKLGFYEWTSRLRSHINPTGTVLLQLENTMQMSKDLLL

SEQ ID NO: 233 - protein, 398 aa, Artificial Sequence
  Synthetic Polypeptide sequence of  Variant No. 189 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYIHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 234 - protein, 398 aa, Artificial Sequence
  Synthetic Polypeptide sequence of  Variant No. 190 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMHPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 235 - protein, 398 aa, Artificial Sequence
  Synthetic Polypeptide sequence of  Variant No. 191 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMSPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 236 - protein, 398 aa, Artificial Sequence
  Synthetic Polypeptide sequence of  Variant No. 192 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWESIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 237 - protein, 398 aa, Artificial Sequence
  Synthetic Polypeptide sequence of  Variant No. 193 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWGSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 238 - protein, 398 aa, Artificial Sequence
  Synthetic Polypeptide sequence of  Variant No. 194 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWRSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 239 - protein, 398 aa, Artificial Sequence
  Synthetic Polypeptide sequence of  Variant No. 195 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWSSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 240 - protein, 398 aa, Artificial Sequence
  Synthetic Polypeptide sequence of  Variant No. 196 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWTSRLRSHINPTGTVLLQLENTMQMSKDLLL

SEQ ID NO: 241 - protein, 398 aa, Artificial Sequence
  Synthetic Polypeptide sequence of  Variant No. 197 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRQLGFYEWASRLRSHINPTGTVLLQLENTMQMSKDLLL

SEQ ID NO: 242 - protein, 398 aa, Artificial Sequence
  Synthetic Polypeptide sequence of  Variant No. 198 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWDSRLRSHINPTGTVLLQLENTMQMSKDLLL

SEQ ID NO: 243 - protein, 398 aa, Artificial Sequence
  Synthetic Polypeptide sequence of  Variant No. 199 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWSSRLRSHINPTGTVLLQLENTMQMSKDLLL

SEQ ID NO: 244 - protein, 398 aa, Artificial Sequence
  Synthetic Polypeptide sequence of  Variant No. 200 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYADSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 245 - protein, 398 aa, Artificial Sequence
  Synthetic Polypeptide sequence of  Variant No. 201 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYTDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 246 - protein, 398 aa, Artificial Sequence
  Synthetic Polypeptide sequence of  Variant No. 202 of  mature Human GLA
LDNGLARTPTMGWLHWERFMCNLDCQEEPDSCISEKLFMEMAELMVSEGWKDAGYEYLAIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 247 - protein, 398 aa, Artificial Sequence
  Synthetic Polypeptide sequence of  Variant No. 203 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYAWDSRLRSHINPTGTVLLQLENTMQMSKDLLL

SEQ ID NO: 248 - protein, 398 aa, Artificial Sequence
  Synthetic Polypeptide sequence of  Variant No. 204 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYDWTSRLRSHINPTGTVLLQLENTMQMSKDLLL

SEQ ID NO: 249 - protein, 398 aa, Artificial Sequence
  Synthetic Polypeptide sequence of  Variant No. 207 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYNWTSRLKSHINPTGTVLLQLENTMQMSKDLLL

SEQ ID NO: 250 - protein, 398 aa, Artificial Sequence
  Synthetic Polypeptide sequence of  Variant No. 208 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYNWTSRLKSHVNPTGTVLLQLENTMQMSKDLLL

SEQ ID NO: 251 - protein, 398 aa, Artificial Sequence
  Synthetic Polypeptide sequence of  Variant No. 209 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYPWDSRLRSHINPTGTVLLQLENTMQMSKDLLL

SEQ ID NO: 252 - protein, 398 aa, Artificial Sequence
  Synthetic Polypeptide sequence of  Variant No. 210 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYNWTSRLRSHINPTGTVLLQLENTMQMSKDLLL

SEQ ID NO: 253 - protein, 398 aa, Artificial Sequence
  Synthetic Polypeptide sequence of  Variant No. 211 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYNWTSRLRSHVNPTGTVLLQLENTMQMSKDLLL

SEQ ID NO: 254 - protein, 398 aa, Artificial Sequence
  Synthetic Polypeptide sequence of  Variant No. 212 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYNWTSRLKSHVNPTGTVLLQLENTMQMSKDLLL

SEQ ID NO: 255 - protein, 398 aa, Artificial Sequence
  Synthetic Polypeptide sequence of  Variant No. 213 of  mature Human GLA
LDNGLARTPTMGWLQWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 256 - protein, 398 aa, Artificial Sequence
  Synthetic Polypeptide sequence of  Variant No. 214 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGDGVACNPACFITQLLPVKRKLGLYNWTSRLRSHINPTGTVLLQLENTMQMSKDLLL

SEQ ID NO: 257 - protein, 398 aa, Artificial Sequence
  Synthetic Polypeptide sequence of  Variant No. 215 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGGGVACNPACFITQLLPVKRKLGFYEWTSRLRSHINPTGTVLLQLENTMQMSKDLLL

SEQ ID NO: 258 - protein, 398 aa, Artificial Sequence
  Synthetic Polypeptide sequence of  Variant No. 216 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGGGVACNPACFITQLLPVKRKLGLYNWTSRLKSHINPTGTVLLQLENTMQMSKDLLL

SEQ ID NO: 259 - protein, 398 aa, Artificial Sequence
  Synthetic Polypeptide sequence of  Variant No. 217 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPACFITQLLPVKRKLGFYEWTSRLRSHINPTGTVLLQLENTMQMSKDLLL

SEQ ID NO: 260 - protein, 398 aa, Artificial Sequence
  Synthetic Polypeptide sequence of  Variant No. 219 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLKSHINPTGTVLLQLENTMQMSKDLLL

SEQ ID NO: 261 - protein, 398 aa, Artificial Sequence
  Synthetic Polypeptide sequence of  Variant No. 220 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYEWTSRLKSHVNPTGTVLLQLENTMQMSKDLLL

SEQ ID NO: 262 - protein, 398 aa, Artificial Sequence
  Synthetic Polypeptide sequence of  Variant No. 221 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTIQMSKDLLL

SEQ ID NO: 263 - protein, 398 aa, Artificial Sequence
  Synthetic Polypeptide sequence of  Variant No. 222 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGQGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWDSRLRSHINPTGTVLLQLENTMQMSKDLLL

SEQ ID NO: 264 - protein, 398 aa, Artificial Sequence
  Synthetic Polypeptide sequence of  Variant No. 223 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPGCFITQLLPVKRQLGFYEWTSRLRSHINPTGTVLLQLENTMQMSKDLLL

SEQ ID NO: 265 - protein, 398 aa, Artificial Sequence
  Synthetic Polypeptide sequence of  Variant No. 224 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGFYNWTSRLRSHINPTGTVLLQLENTMQMSKDLLL

SEQ ID NO: 266 - protein, 398 aa, Artificial Sequence
  Synthetic Polypeptide sequence of  Variant No. 225 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGSSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSKDLLL

SEQ ID NO: 267 - protein, 398 aa, Artificial Sequence
  Synthetic Polypeptide sequence of  Variant No. 226 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYEWTSRLRSHINPTGTVLLQLENTMQMSKDLLL

SEQ ID NO: 268 - protein, 398 aa, Artificial Sequence
  Synthetic Polypeptide sequence of  Variant No. 227 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINHQEIGGPRSYTIAVASLGKGVACNPACFITQLLPVKRKLGFYEWTSRLRSHINPTGTVLLQLENTMQMSKDLLL

SEQ ID NO: 269 - protein, 398 aa, Artificial Sequence
  Synthetic Polypeptide sequence of  Variant No. 228 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHINPTGTVLLQLENTMQMSKDLLL

SEQ ID NO: 270 - protein, 398 aa, Artificial Sequence
  Synthetic Polypeptide sequence of  Variant No. 229 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSKDLLL

SEQ ID NO: 271 - protein, 398 aa, Artificial Sequence
  Synthetic Polypeptide sequence of  Variant No. 230 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRRHINPTGTVLLQLENTMQMSKDLLL

SEQ ID NO: 272 - protein, 398 aa, Artificial Sequence
  Synthetic Polypeptide sequence of  Variant No. 231 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWDSRLRSHINPTGTVLLQLENTMQMSKDLLL

SEQ ID NO: 273 - protein, 398 aa, Artificial Sequence
  Synthetic Polypeptide sequence of  Variant No. 232 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWSSRLRSHINPTGTVLLQLENTMQMSKDLLL

SEQ ID NO: 274 - protein, 398 aa, Artificial Sequence
  Synthetic Polypeptide sequence of  Variant No. 233 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPGCFITQLLPVKRKLGFYDWDSRLRSHINPTGTVLLQLENTMQMSLKDLL

SEQ ID NO: 275 - protein, 398 aa, Artificial Sequence
  Synthetic Polypeptide sequence of  Variant No. 234 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPGCFITQLLPVKRKLGFYDWDSRLRSHINPTGTVLLQLENTMQMSLKDLL

SEQ ID NO: 276 - protein, 398 aa, Artificial Sequence
  Synthetic Polypeptide sequence of  Variant No. 235 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAMINRQEIGGPRSYTIPVASLGKGVACNPGCFITQLLPVKRKLGFYDWDSRLRSHINPTGTVLLQLENTMQMSLKDLL

SEQ ID NO: 277 - protein, 398 aa, Artificial Sequence
  Synthetic Polypeptide sequence of  Variant No. 236 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYDWDSRLRSHINPTGTVLLQLENTMQMSLKDLL

SEQ ID NO: 278 - protein, 398 aa, Artificial Sequence
  Synthetic Polypeptide sequence of  Variant No. 237 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAMINRQEIGGPRSYTIPVASLGKGVACNPGCFITQLLPVKRKLGFYDWDSRLRSHINPTGTVLLQLENTMQMSLKDLL

SEQ ID NO: 279 - protein, 398 aa, Artificial Sequence
  Synthetic Polypeptide sequence of  Variant No. 238 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGGGVACNPACFITQLLPVKRKLGLYEWTSRLKSHVNPTGTVLLQLENTMQMSLKDLL

SEQ ID NO: 280 - protein, 398 aa, Artificial Sequence
  Synthetic Polypeptide sequence of  Variant No. 239 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGDGVACNPACFITQLLPVKRKLGLYEWTSRLKSHVNPTGTVLLQLENTMQMSLKDLL

SEQ ID NO: 281 - protein, 398 aa, Artificial Sequence
  Synthetic Polypeptide sequence of  Variant No. 240 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDIRHISPQAKALLQDKDVIAINQDPLGKQGYQLRQGDNFEVWERPLSGLAWAVAMINRQEIGGPRSYTIAVASLGKGVACNLACFITQLLPVKRKLGFYEWTSRLKSHINPTGTVLLQLENTMQMSLKDLL

SEQ ID NO: 282 - protein, 398 aa, Artificial Sequence
  Synthetic Polypeptide sequence of  Variant No. 241 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGFYEWTSRLKSHVNPTGTVLLQLENTMQMSLKDLL

SEQ ID NO: 283 - protein, 398 aa, Artificial Sequence
  Synthetic Polypeptide sequence of  Variant No. 242 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGGGVACNPACFITQLLPVKRKLGLYEWTSRLKSHINPTGTVLLQLENTMQMSLKDLL

SEQ ID NO: 284 - protein, 398 aa, Artificial Sequence
  Synthetic Polypeptide sequence of  Variant No. 243 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIPVASLGGGVACNPGCFITQLLPVKRKLGFYEWTSRLRSHINPTGTVLLQLENTMQMSLKDLL

SEQ ID NO: 285 - protein, 398 aa, Artificial Sequence
  Synthetic Polypeptide sequence of  Variant No. 244 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAMINRQEIGGPRSYTIAVASLGKGVACNPGCFITQLLPVKRKLGFYEWTSRLRSHINPTGTVLLQLENTMQMSLKDLL

SEQ ID NO: 286 - protein, 398 aa, Artificial Sequence
  Synthetic Polypeptide sequence of  Variant No. 245 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGLYEWTSRLKSHVNPTGTVLLQLENTMQMSLKDLL

SEQ ID NO: 287 - protein, 398 aa, Artificial Sequence
  Synthetic Polypeptide sequence of  Variant No. 246 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAMINRQEIGGPRSYTIPVASLGKGVACNPACFITQLLPVKRKLGFYEWTSRLRSHINPTGTVLLQLENTMQMSLKDLL

SEQ ID NO: 288 - protein, 398 aa, Artificial Sequence
  Synthetic Polypeptide sequence of  Variant No. 247 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGFYEWTSRLKSHINPTGTVLLQLENTMQMSLKDLL

SEQ ID NO: 289 - protein, 398 aa, Artificial Sequence
  Synthetic Polypeptide sequence of  Variant No. 248 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGGGVACNPACFITQLLPVKRKLGFYEWTSRLKSHINPTGTVLLQLENTMQMSLKDLL

SEQ ID NO: 290 - protein, 398 aa, Artificial Sequence
  Synthetic Polypeptide sequence of  Variant No. 249 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYEWTSRLKSHINPTGTVLLQLENTMQMSLKDLL

SEQ ID NO: 291 - protein, 398 aa, Artificial Sequence
  Synthetic Polypeptide sequence of  Variant No. 250 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 292 - protein, 398 aa, Artificial Sequence
  Synthetic Polypeptide sequence of  Variant No. 251 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 293 - protein, 398 aa, Artificial Sequence
  Synthetic Polypeptide sequence of  Variant No. 252 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYDWDSRLRSHINPTGTVLLQLENTMQMSLKDLL

SEQ ID NO: 294 - protein, 398 aa, Artificial Sequence
  Synthetic Polypeptide sequence of  Variant No. 253 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAMINRQEIGGPRSYTIPVASLGKGVACNPACFITQLLPVKRKLGFYDWDSRLRSHINPTGTVLLQLENTMQMSLKDLL

SEQ ID NO: 295 - protein, 398 aa, Artificial Sequence
  Synthetic Polypeptide sequence of  Variant No. 254 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 296 - protein, 398 aa, Artificial Sequence
  Synthetic Polypeptide sequence of  Variant No. 255 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGDGVACNPACFITQLLPVKRKLGLYEWTSRLRSHVNPTGTVLLQLENTMQMSLKDLL

SEQ ID NO: 297 - protein, 398 aa, Artificial Sequence
  Synthetic Polypeptide sequence of  Variant No. 256 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGDGVACNPACFITQLLPVKRKLGLYEWTSRLRSHVNPTGTVLLQLENTMQMSLKDLL

SEQ ID NO: 298 - protein, 398 aa, Artificial Sequence
  Synthetic Polypeptide sequence of  Variant No. 257 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGDGVACNPACFITQLLPVKRKLGLYEWTSRLRSHVNPTGTVLLQLENTMQMSLKDLL

SEQ ID NO: 299 - protein, 398 aa, Artificial Sequence
  Synthetic Polypeptide sequence of  Variant No. 258 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGDGVACNPACFITQLLPVKRKLGFYEWTSRLRSHVNPTGTVLLQLENTMQMSLKDLL

SEQ ID NO: 300 - protein, 398 aa, Artificial Sequence
  Synthetic Polypeptide sequence of  Variant No. 259 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGLYEWTSRLKSHVNPTGTVLLQLENTMQMSLKDLL

SEQ ID NO: 301 - protein, 398 aa, Artificial Sequence
  Synthetic Polypeptide sequence of  Variant No. 260 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYEWTSRLKSHVNPTGTVLLQLENTMQMSLKDLL

SEQ ID NO: 302 - protein, 398 aa, Artificial Sequence
  Synthetic Polypeptide sequence of  Variant No. 261 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGFYEWTSRLRSHVNPTGTVLLQLENTMQMSLKDLL

SEQ ID NO: 303 - protein, 398 aa, Artificial Sequence
  Synthetic Polypeptide sequence of  Variant No. 262 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGLYEWTSRLKSHVNPTGTVLLQLENTMQMSLKDLL

SEQ ID NO: 304 - protein, 398 aa, Artificial Sequence
  Synthetic Polypeptide sequence of  Variant No. 263 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGFYEWTSRLRSHVNPTGTVLLQLENTMQMSLKDLL

SEQ ID NO: 305 - protein, 398 aa, Artificial Sequence
  Synthetic Polypeptide sequence of  Variant No. 264 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGDGVACNPACFITQLLPVKRKLGFYEWTSRLKSHVNPTGTVLLQLENTMQMSLKDLL

SEQ ID NO: 306 - protein, 398 aa, Artificial Sequence
  Synthetic Polypeptide sequence of  Variant No. 265 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 307 - protein, 398 aa, Artificial Sequence
  Synthetic Polypeptide sequence of  Variant No. 266 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGEGVACNPACFITQLLPVKRKLGLYEWTSRLKSHINPTGTVLLQLENTMQMSLKDLL

SEQ ID NO: 308 - protein, 398 aa, Artificial Sequence
  Synthetic Polypeptide sequence of  Variant No. 267 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIAVASLGDGVACNPACFITQLLPVKRKLGLYEWTSRLKSHINPTGTVLLQLENTMQMSLKDLL

SEQ ID NO: 309 - protein, 398 aa, Artificial Sequence
  Synthetic Polypeptide sequence of  Variant No. 268 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLKSHVNPTGTVLLQLENTMQMSLKDLL

SEQ ID NO: 310 - protein, 398 aa, Artificial Sequence
  Synthetic Polypeptide sequence of  Variant No. 269 of  mature Human GLA
LDNGLARTPTMGWLHWERFMCNLDCQEEPDSCISEKIFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYEWTSRLKSHINPTGTVLLQLENTMQMSLKDLL

SEQ ID NO: 311 - protein, 398 aa, Artificial Sequence
  Synthetic Polypeptide sequence of  Variant No. 270 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYYDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPGCFITQLLPVKRKLGFYEWTSRLRSHINPTGTVLLQLENTMQMSLKDLL

SEQ ID NO: 312 - protein, 398 aa, Artificial Sequence
  Synthetic Polypeptide sequence of  Variant No. 271 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTGIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPGCFITQLLPVKRKLGFYEWTSRLRSHINPTGTVLLQLENTMQMSLKDLL

SEQ ID NO: 313 - protein, 398 aa, Artificial Sequence
  Synthetic Polypeptide sequence of  Variant No. 272 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 314 - protein, 398 aa, Artificial Sequence
  Synthetic Polypeptide sequence of  Variant No. 273 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYDWDSRLRSHINPTGTVLLQLENTMQMSLKDLL

SEQ ID NO: 315 - protein, 398 aa, Artificial Sequence
  Synthetic Polypeptide sequence of  Variant No. 274 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPGCFITQLLPVKRKLGFYEWTSRLRSHINPTGTVLLQLENTMQMSLKDLL

SEQ ID NO: 316 - protein, 398 aa, Artificial Sequence
  Synthetic Polypeptide sequence of  Variant No. 275 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQMSLKDLL

SEQ ID NO: 317 - protein, 398 aa, Artificial Sequence
  Synthetic Polypeptide sequence of  Variant No. 276 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIPVASLGKGVACNPGCFITQLLPVKRKLGFYDWDSRLRSHINPTGTVLLQLENTMQMSLKDLL

SEQ ID NO: 318 - protein, 398 aa, Artificial Sequence
  Synthetic Polypeptide sequence of  Variant No. 277 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIPVASLGKGVACNPACFITQLLPVKRKLGFYDWDSRLRSHINPTGTVLLQLENTMQMSLKDLL

SEQ ID NO: 319 - protein, 398 aa, Artificial Sequence
  Synthetic Polypeptide sequence of  Variant No. 278 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIAVASLGKGVACNPGCFITQLLPVKRKLGFYDWDSRLRSHINPTGTVLLQLENTMQMSLKDLL

SEQ ID NO: 320 - protein, 398 aa, Artificial Sequence
  Synthetic Polypeptide sequence of  Variant No. 279 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPGCFITQLLPVKRKLGFYEWTSRLRSHINPTGTVLLQLENTMQMSLKDLL

SEQ ID NO: 321 - protein, 398 aa, Artificial Sequence
  Synthetic Polypeptide sequence of  Variant No. 280 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPACFITQLLPVKRKLGFYDWDSRLRSHINPTGTVLLQLENTMQMSLKDLL

SEQ ID NO: 322 - protein, 398 aa, Artificial Sequence
  Synthetic Polypeptide sequence of  Variant No. 281 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGLYEWTSRLKSHINPTGTVLLQLENTMQMSLKDLL

SEQ ID NO: 323 - protein, 398 aa, Artificial Sequence
  Synthetic Polypeptide sequence of  Variant No. 282 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIPVASLGKGVACNPACFITQLLPVKRKLGFYEWTSRLRSHINPTGTVLLQLENTMQMSLKDLL

SEQ ID NO: 324 - protein, 398 aa, Artificial Sequence
  Synthetic Polypeptide sequence of  Variant No. 283 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPGCFITQLLPVKRKLGFYDWDSRLRSHINPTGTVLLQLENTMQMSLKDLL

SEQ ID NO: 325 - protein, 398 aa, Artificial Sequence
  Synthetic Polypeptide sequence of  Variant No. 284 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGDGVACNPACFITQLLPVKRKLGLYEWTSRLRSHVNPTGTVLLQLENTMQMSLKDLL

SEQ ID NO: 326 - protein, 398 aa, Artificial Sequence
  Synthetic Polypeptide sequence of  Variant No. 285 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 327 - protein, 398 aa, Artificial Sequence
  Synthetic Polypeptide sequence of  Variant No. 286 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLL

SEQ ID NO: 328 - protein, 398 aa, Artificial Sequence
  Synthetic Polypeptide sequence of  Variant No. 287 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPGCFITQLLPVKRKLGFYEWTSRLRSHINPTGTVLLQLENTMQMSLKDLL

SEQ ID NO: 329 - protein, 398 aa, Artificial Sequence
  Synthetic Polypeptide sequence of  Variant No. 288 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAMINRQEIGGPRSYTIPVASLGKGVACNPGCFITQLLPVKRKLGFYDWDSRLRSHINPTGTVLLQLENTMQMSLKDLL

SEQ ID NO: 330 - protein, 398 aa, Artificial Sequence
  Synthetic Polypeptide sequence of  Variant No. 289 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAMINRQEIGGPRSYTIAVASLGKGVACNPGCFITQLLPVKRKLGFYEWTSRLRSHINPTGTVLLQLENTMQMSLKDLL

SEQ ID NO: 331 - protein, 398 aa, Artificial Sequence
  Synthetic Polypeptide sequence of  Variant No. 290 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAMINRQEIGGPRSYTIPVASLGKGVACNPGCFITQLLPVKRKLGFYDWDSRLRSHINPTGTVLLQLENTMQMSLKDLL

SEQ ID NO: 332 - protein, 398 aa, Artificial Sequence
  Synthetic Polypeptide sequence of  Variant No. 291 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGLYEWTSRLRSHINPTGTVLLQLENTMQMSLKDLL

SEQ ID NO: 333 - protein, 398 aa, Artificial Sequence
  Synthetic Polypeptide sequence of  Variant No. 292 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNHERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGFYEWTSRLKSHVNPTGTVLLQLENTMQMSLKDLL

SEQ ID NO: 334 - protein, 398 aa, Artificial Sequence
  Synthetic Polypeptide sequence of  Variant No. 293 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGLYEWTSRLRSHVNPTGTVLLQLENTMQMSLKDLL

SEQ ID NO: 335 - protein, 398 aa, Artificial Sequence
  Synthetic Polypeptide sequence of  Variant No. 294 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYEWTSRLRSHVNPTGTVLLQLENTMQMSLKDLL

SEQ ID NO: 336 - protein, 398 aa, Artificial Sequence
  Synthetic Polypeptide sequence of  Variant No. 295 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGLYEWTSRLKSHVNPTGTVLLQLENTMQMSLKDLL

SEQ ID NO: 337 - protein, 398 aa, Artificial Sequence
  Synthetic Polypeptide sequence of  Variant No. 296 of  mature Human GLA
LDNGLARTPTMGWLHWERFMCNLDCQEEPDSCISEKLFMEMAELMVSEGWKDAGYEYLCIDDCWMTPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIPVASLGGGVACNPGCFITQLLPVKRKLGFYNWTSRLKSHINPTGTVLLQLENTMQMSLKDLL

SEQ ID NO: 338 - protein, 398 aa, Artificial Sequence
  Synthetic Polypeptide sequence of  Variant No. 297 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGVWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWSSRLKSHINPTGTVLLQLENTMQMSLKDLL

SEQ ID NO: 339 - protein, 398 aa, Artificial Sequence
  Synthetic Polypeptide sequence of  Variant No. 298 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIPVASLGKGVACNPGCFITQLLPVKRQLGFYNWTSRLKSHINPTGTVLLQLENTMQMSLKDLL

SEQ ID NO: 340 - protein, 398 aa, Artificial Sequence
  Synthetic Polypeptide sequence of  Variant No. 299 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGGGVACNPGCFITQLLPVKRKLGFYTWTSRLKSHINPTGTVLLQLENTMQMSLKDFL

SEQ ID NO: 341 - protein, 398 aa, Artificial Sequence
  Synthetic Polypeptide sequence of  Variant No. 300 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGGGVACNPACFITQLLPVKRKLGFYNWTSRLKSHINPTGTVLLQLENTMQMSLKDLL

SEQ ID NO: 342 - protein, 398 aa, Artificial Sequence; identical to SEQ ID NO: 13
  Synthetic Polypeptide sequence of  Variant No. 301 of  mature Human GLA

SEQ ID NO: 343 - protein, 398 aa, Artificial Sequence
  Synthetic Polypeptide sequence of  Variant No. 302 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGGGVACNPACFITQLLPVKRKLGFYNWTSRLKSHINPTGTVLLQLENTMQMSLKDLL

SEQ ID NO: 344 - protein, 398 aa, Artificial Sequence
  Synthetic Polypeptide sequence of  Variant No. 303 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIEVASLGDGVACNPACFITQLLPVKRKLGLYNWTSRLKSHVNPTGTVLLQLENTMQMSLKDLL

SEQ ID NO: 345 - protein, 398 aa, Artificial Sequence
  Synthetic Polypeptide sequence of  Variant No. 304 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPGCFITQLLPVKRQLGFYNWTSRLKSHINPTGTVLLQLENTMQMSLKDLL

SEQ ID NO: 346 - protein, 398 aa, Artificial Sequence
  Synthetic Polypeptide sequence of  Variant No. 305 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYNWSSRLKSHINPTGTVLLQLENTMQMSLKDLL

SEQ ID NO: 347 - protein, 398 aa, Artificial Sequence
  Synthetic Polypeptide sequence of  Variant No. 306 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWTSRLKSHINPTGTVLLQLENTMQMSLKDLL

SEQ ID NO: 348 - protein, 398 aa, Artificial Sequence
  Synthetic Polypeptide sequence of  Variant No. 307 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGGGVACNPACFITQLLPVKRKLGFYNWSSRLKSHVNPTGTVLLQLENTMQMSLKDLL

SEQ ID NO: 349 - protein, 398 aa, Artificial Sequence
  Synthetic Polypeptide sequence of  Variant No. 308 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYNWSSRLKSHINPTGTVLLQLENTMQMSLKDLL

SEQ ID NO: 350 - protein, 398 aa, Artificial Sequence
  Synthetic Polypeptide sequence of  Variant No. 309 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIPVASLGGGVACNPGCFITQLLPVKRKLGFYNWTSRLKSHINPTGTVLLQLENTMQMSLKDLL

SEQ ID NO: 351 - protein, 398 aa, Artificial Sequence
  Synthetic Polypeptide sequence of  Variant No. 310 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPGCFITQLLPVKRKLGFYNWSSRLKSHINPTGTVLLQLENTMQMSLKDLL

SEQ ID NO: 352 - protein, 398 aa, Artificial Sequence
  Synthetic Polypeptide sequence of  Variant No. 311 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPGCFITQLLPVKRKLGFYNWSSRLKSHINPTGTVLLQLENTMQMSLKDLL

SEQ ID NO: 353 - protein, 398 aa, Artificial Sequence
  Synthetic Polypeptide sequence of  Variant No. 312 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPGCFITQLLPVKRQLGFYNWTSRLKSHINPTGTVLLQLENTMQMSLKDLL

SEQ ID NO: 354 - protein, 398 aa, Artificial Sequence
  Synthetic Polypeptide sequence of  Variant No. 313 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDSQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGGGVACNPACFITQLLPVKRKLGFYNWTSRLKSHINPTGTVLLQLENTMQMSLKDLL

SEQ ID NO: 355 - protein, 398 aa, Artificial Sequence
  Synthetic Polypeptide sequence of  Variant No. 314 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGDGVACNPACFITQLLPVKRKLGFYNWTSRLKSHVNPTGTVLLQLENTMQMSLKDLL

SEQ ID NO: 356 - protein, 398 aa, Artificial Sequence
  Synthetic Polypeptide sequence of  Variant No. 315 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGLYNWTSRLKSHVNPTGTVLLQLENTMQMSLKDLL

SEQ ID NO: 357 - protein, 398 aa, Artificial Sequence
  Synthetic Polypeptide sequence of  Variant No. 316 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGFYNWTSRLKSHINPTGTVLLQLENTMQMSLKDLL

SEQ ID NO: 358 - protein, 398 aa, Artificial Sequence
  Synthetic Polypeptide sequence of  Variant No. 317 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGDGVACNPACFITQLLPVKRKLGLYNWTSRLKSHINPTGTVLLQLENTMQMSLKDLL

SEQ ID NO: 359 - protein, 398 aa, Artificial Sequence
  Synthetic Polypeptide sequence of  Variant No. 318 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYNWTSRLKSHVNPTGTVLLQLENTMQMSLKDLL

SEQ ID NO: 360 - protein, 398 aa, Artificial Sequence
  Synthetic Polypeptide sequence of  Variant No. 319 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYNWTSRLKSHVNPTGTVLLQLENTMQMSLKDLL

SEQ ID NO: 361 - protein, 398 aa, Artificial Sequence
  Synthetic Polypeptide sequence of  Variant No. 320 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWTSRLKSHINPTGTVLLQLENTMQMSLKDLL

SEQ ID NO: 362 - protein, 398 aa, Artificial Sequence
  Synthetic Polypeptide sequence of  Variant No. 321 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGGGVACNPACFITQLLPVKRKLGFYNWTSRLKSHINPTGTVLLQLENTMQMSLKDLL

SEQ ID NO: 363 - protein, 398 aa, Artificial Sequence
  Synthetic Polypeptide sequence of  Variant No. 322 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGDGVACNPACFITQLLPVKRKLGFYNWTSRLKSHINPTGTVLLQLENTMQMSLKDLL

SEQ ID NO: 364 - protein, 398 aa, Artificial Sequence
  Synthetic Polypeptide sequence of  Variant No. 323 of  mature Human GLA
LDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLAINRTGRSIVYSCEWPLYMWPFQKPNYTEIRQYCNHWRNFADIDDSWASIKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYNWTSRLKSHINPTGTVLLQLENTMQMSLKDLL

SEQ ID NO: 365 - protein, 398 aa, Artificial Sequence
  Synthetic Polypeptide sequence of  Variant No. 324 of  mature Human GLA
LDNGLARTPTMGWLHWERFMCNSDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYNWTSRLKSHINPTGTVLLQLENTMQMSLKDLL

SEQ ID NO: 366 - protein, 398 aa, Artificial Sequence
  Synthetic Polypeptide sequence of  Variant No. 325 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIPVASLGGGVACNPACFITQLLPVKRQLGFYNWTSRLKSHINPTGTVLLQLENTMQMSLKDLL

SEQ ID NO: 367 - protein, 398 aa, Artificial Sequence; identical to SEQ ID NO: 15
  Synthetic Polypeptide sequence of  Variant No. 326 of  mature Human GLA

SEQ ID NO: 368 - protein, 398 aa, Artificial Sequence
  Synthetic Polypeptide sequence of  Variant No. 327 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIAVASLGDGVACNPGCFITQLLPVKRQLGFYNWTSRLKSHINPTGTVLLQLENTMQMSLKDLL

SEQ ID NO: 369 - protein, 398 aa, Artificial Sequence
  Synthetic Polypeptide sequence of  Variant No. 328 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIPVASLGKGVACNPGCFITQLLPVKRKLGFYNWSSRLKSHINPTGTVLLQLENTMQMSLKDLL

SEQ ID NO: 370 - protein, 398 aa, Artificial Sequence
  Synthetic Polypeptide sequence of  Variant No. 329 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGDGVACNPACFITQLLPVKRKLGFYNWTSRLKSHINPTGTVLLQLENTMQMSLKDLL

SEQ ID NO: 371 - protein, 398 aa, Artificial Sequence
  Synthetic Polypeptide sequence of  Variant No. 330 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGDGVACNPACFITQLLPVKRKLGFYNWTSRLKSHINPTGTVLLQLENTMQMSLKDLL

SEQ ID NO: 372 - protein, 398 aa, Artificial Sequence
  Synthetic Polypeptide sequence of  Variant No. 331 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGDGVACNPACFITQLLPVKRKLGFYNWTSRLKSHVNPTGTVLLQLENTMQMSLKDLL

SEQ ID NO: 373 - protein, 398 aa, Artificial Sequence
  Synthetic Polypeptide sequence of  Variant No. 332 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGGGVACNPACFITQLLPVKRKLGLYNWTSRLKSHVNPTGTVLLQLENTMQMSLKDLL

SEQ ID NO: 374 - protein, 398 aa, Artificial Sequence
  Synthetic Polypeptide sequence of  Variant No. 333 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGDAWAVAIINRQEIGGPRSYTIPVASLGKGVACNPGCFITQLLPVKRKLGFYNWSSRLKSHINPTGTVLLQLENTMQMSLKDLL

SEQ ID NO: 375 - protein, 398 aa, Artificial Sequence
  Synthetic Polypeptide sequence of  Variant No. 334 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIAVASLGKGVACNPGCFITQLLPVKRQLGFYNWSSRLKSHINPTGTVLLQLENTMQMSLKDLL

SEQ ID NO: 376 - protein, 398 aa, Artificial Sequence
  Synthetic Polypeptide sequence of  Variant No. 335 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGDAWAVAIINRQEIGGPRSYTIAVASLGGGVACNPGCFITQLLPVKRQLGFYNWSSRLKSHINPTGTVLLQLENTMQMSLKDLL

SEQ ID NO: 377 - protein, 398 aa, Artificial Sequence
  Synthetic Polypeptide sequence of  Variant No. 336 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPGCFITQLLPVKRKLGFYNWSSRLKSHINPTGTVLLQLENTMQMSLKDLL

SEQ ID NO: 378 - protein, 398 aa, Artificial Sequence
  Synthetic Polypeptide sequence of  Variant No. 337 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGDGVACNPACFITQLLPVKRKLGFYNWTSRLKSHINPTGTVLLQLENTMQMSLKDLL

SEQ ID NO: 379 - protein, 398 aa, Artificial Sequence
  Synthetic Polypeptide sequence of  Variant No. 338 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPGCFITQLLPVKRQLGFYNWTSRLKSHINPTGTVLLQLENTMQMSLKDLL

SEQ ID NO: 380 - protein, 398 aa, Artificial Sequence; identical to SEQ ID NO: 379
  Synthetic Polypeptide sequence of  Variant No. 339 of  mature Human GLA

SEQ ID NO: 381 - protein, 398 aa, Artificial Sequence
  Synthetic Polypeptide sequence of  Variant No. 340 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPGCFITQLLPVKRQLGFYNWSSRLKSHINPTGTVLLQLENTMQMSLKDLL

SEQ ID NO: 382 - protein, 398 aa, Artificial Sequence
  Synthetic Polypeptide sequence of  Variant No. 341 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGFYNWSSRLKSHINPTGTVLLQLENTMQMSLKDLL

SEQ ID NO: 383 - protein, 398 aa, Artificial Sequence
  Synthetic Polypeptide sequence of  Variant No. 342 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRKLGFYNWTSRLKSHINPTGTVLLQLENTMQMSLKDLL

SEQ ID NO: 384 - protein, 398 aa, Artificial Sequence
  Synthetic Polypeptide sequence of  Variant No. 343 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWSSRLKSHINPTGTVLLQLENTMQMSLKDLL

SEQ ID NO: 385 - protein, 398 aa, Artificial Sequence
  Synthetic Polypeptide sequence of  Variant No. 344 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRQLGFYNWTSRLKSHINPTGTVLLQLENTMQMSLKDLL

SEQ ID NO: 386 - protein, 398 aa, Artificial Sequence
  Synthetic Polypeptide sequence of  Variant No. 345 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNPERIVDVAGPGGWNDPDMLVIGNFGLSWDQQVTQKALWAIMAAPLFMFNDLRHISPQAKALLQDKEVIAINPDPFGKQGYQLRKGDNFEGWERPLFGLAWAVAIINRQEIGGPRSYTIPVASLGEGVACNPACFITQLLPVKRKLGFYNWTSRLKSHINPTGTVLLQLENTMQMSLKDLL

SEQ ID NO: 387 - protein, 398 aa, Artificial Sequence
  Synthetic Polypeptide sequence of  Variant No. 346 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPGCFITQLLPVKRQLGFYNWSSRLKSHINPTGTVLLQLENTMQMSLKDLL

SEQ ID NO: 388 - protein, 398 aa, Artificial Sequence
  Synthetic Polypeptide sequence of  Variant No. 347 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSIGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIPVASLGKGVACNPACFITQLLPVKRKLGFYNWSSRLKSHINPTGTVLLQLENTMQMSLKDLL

SEQ ID NO: 389 - protein, 398 aa, Artificial Sequence
  Synthetic Polypeptide sequence of  Variant No. 348 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQEKIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGGGVACNPACFITQLLPVKRKLGLYNWTSRLKSHINPTGTVLLQLENTMQMSLKDLL

SEQ ID NO: 390 - protein, 398 aa, Artificial Sequence
  Synthetic Polypeptide sequence of  Variant No. 349 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGLYNWTSRLKSHINPTGTVLLQLENTMQMSLKDLL

SEQ ID NO: 391 - protein, 398 aa, Artificial Sequence
  Synthetic Polypeptide sequence of  Variant No. 350 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAVINRQEIGGPRSYTIAVASLGKGVACNPACFITQLLPVKRKLGFYNWTSRLKSHVNPTGTVLLQLENTMQMSLKDLL

SEQ ID NO: 392 - protein, 398 aa, Artificial Sequence
  Synthetic Polypeptide sequence of  Variant No. 351 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASVKSILDWTSFNQETIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWTSRLKSHVNPTGTVLLQLENTMQMSLKDLL

SEQ ID NO: 393 - protein, 398 aa, Artificial Sequence
  Synthetic Polypeptide sequence of  Variant No. 352 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQEKIVDVAGPGGWNDPDMLVIGNFGLSWNQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWTSRLKSHVNPTGTVLLQLENTMQMSLKDLL

SEQ ID NO: 394 - protein, 398 aa, Artificial Sequence
  Synthetic Polypeptide sequence of  Variant No. 353 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGLYNWTSRLKSHVNPTGTVLLQLENTMQMSLKDLL

SEQ ID NO: 395 - protein, 398 aa, Artificial Sequence
  Synthetic Polypeptide sequence of  Variant No. 354 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAIINRQEIGGPRSYTIAVASLGKGVACNPACFITQLLPVKRKLGLYNWTSRLKSHINPTGTVLLQLENTMQMSLKDLL

SEQ ID NO: 396 - protein, 398 aa, Artificial Sequence
  Synthetic Polypeptide sequence of  Variant No. 355 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRQGDNFEVWERPLSGLAWAVAIINRQEIGGPRSYTIAVASLGDGVACNPACFITQLLPVKRKLGFYNWTSRLKSHVNPTGTVLLQLENTMQMSLKDLL

SEQ ID NO: 397 - protein, 398 aa, Artificial Sequence
  Synthetic Polypeptide sequence of  Variant No. 356 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAIINRQEIGGPRSYTIAVASLGKGVACNPACFITQLLPVKRKLGFYNWTSRLKSHINPTGTVLLQLENTMQMSLKDLL

SEQ ID NO: 398 - protein, 398 aa, Artificial Sequence
  Synthetic Polypeptide sequence of  Variant No. 357 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGFYNWTSRLKSHVNPTGTVLLQLENTMQMSLKDLL

SEQ ID NO: 399 - protein, 398 aa, Artificial Sequence; identical to SEQ ID NO: 397
  Synthetic Polypeptide sequence of  Variant No. 358 of  mature Human GLA

SEQ ID NO: 400 - protein, 398 aa, Artificial Sequence
  Synthetic Polypeptide sequence of  Variant No. 359 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKFGIYADVGNKTCAGFPGSFGYYDIDAQTFADWGVDLLKFDGCYCDSLENLADGYKHMSLALNRTGRSIVYSCEWPLYMWPFIKPNYTEIRQYCNHWRNFADIDDSWASIKSILDWTSFNQETIVDVAGPGGWNDPDMLVIGNFGLSWDQQVTQMALWAIMAAPLFMSNDLRHISPQAKALLQDKDVIAINQDPLGKQGYQLRKGDNFEVWERPLSGLAWAVAVINRQEIGGPRSYTIAVASLGKGVACNPACFITQLLPVKRKLGFYNWTSRLKSHVNPTGTVLLQLENTMQMSLKDLL

SEQ ID NO: 401 - protein, 398 aa, Artificial Sequence
  Synthetic Polypeptide sequence of  Variant No. 360 of  mature Human GLA
LDNGLARTPTMGWLHWERFMCNLDCQEEPDSCISEKLFMEMAEEMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 402 - protein, 398 aa, Artificial Sequence
  Synthetic Polypeptide sequence of  Variant No. 361 of  mature Human GLA
LDNGLARTPTMGWLHWERFMCNLDCQEEPDSCISEKLFMEMAERMVREGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 403 - protein, 398 aa, Artificial Sequence
  Synthetic Polypeptide sequence of  Variant No. 362 of  mature Human GLA
LDNGLARTPTMGWLHWERFMCNLDCQEEPDSCISEKLFMEMAECMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 404 - protein, 398 aa, Artificial Sequence
  Synthetic Polypeptide sequence of  Variant No. 363 of  mature Human GLA
LDNGLARTPTMGWLHWERFMCNLDCQEEPDSCISEKLFMEMAERMVDEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 405 - protein, 398 aa, Artificial Sequence
  Synthetic Polypeptide sequence of  Variant No. 364 of  mature Human GLA
LDNGLARTPTMGWLHWERFMCNLDCQEEPDSCISEKLFHEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 406 - protein, 398 aa, Artificial Sequence
  Synthetic Polypeptide sequence of  Variant No. 365 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 407 - protein, 398 aa, Artificial Sequence
  Synthetic Polypeptide sequence of  Variant No. 366 of  mature Human GLA
LDNGLARTPTMGWLHWERFMCNLDCQEEPDSCISEKLFMEMAERMVVEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 408 - protein, 398 aa, Artificial Sequence
  Synthetic Polypeptide sequence of  Variant No. 367 of  mature Human GLA
LDNGLARTPTMGWLHWERFMCNLDCQEEPDSCISEKLFREMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 409 - protein, 398 aa, Artificial Sequence
  Synthetic Polypeptide sequence of  Variant No. 368 of  mature Human GLA
LDNGLARTPTMGWLHWERFMCNLDCQEEPDSCISEKLFMEMAEAMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 410 - protein, 398 aa, Artificial Sequence
  Synthetic Polypeptide sequence of Variant No. 369 of mature Human GLA
LDNGLARTPTMGWLHWERFMCNLDCQEEPDSCISEKLFMEMAESMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 411 - protein, 398 aa, Artificial Sequence
  Synthetic Polypeptide sequence of  Variant No. 370 of  mature Human GLA
LDNGLARTPTMGWLHWERFMCNLDCQEEPDSCISEKLFMEMAEQMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 412 - protein, 398 aa, Artificial Sequence
  Synthetic Polypeptide sequence of  Variant No. 371 of  mature Human GLA
LDNGLARTPTMGWLHWERFMCNLDCQEEPDSCISEKLFMEMAEWMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 413 - protein, 398 aa, Artificial Sequence
  Synthetic Polypeptide sequence of  Variant No. 372 of  mature Human GLA
LDNGLARTPTMGWLHWERFMCNLDCQEEPDSCISEKLFMEMAEVMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 414 - protein, 398 aa, Artificial Sequence
  Synthetic Polypeptide sequence of  Variant No. 373 of  mature Human GLA
LDNGLARTPTMGWLHWERFMCNLDCQEEPDSCISEKLFMERAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 415 - protein, 398 aa, Artificial Sequence
  Synthetic Polypeptide sequence of  Variant No. 374 of  mature Human GLA
LDNGLARTPTMGWLHWERFMCNLDCQEEPDSCISEKLFMEMAEMMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 416 - protein, 398 aa, Artificial Sequence
  Synthetic Polypeptide sequence of  Variant No. 375 of  mature Human GLA
LDNGLARTPTMGWLHWERFMCNLDCQEEPDSCISEKLFMEMAERMVIEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 417 - protein, 398 aa, Artificial Sequence
  Synthetic Polypeptide sequence of  Variant No. 376 of  mature Human GLA
LDNGLARTPTMGWLHWERFMCNLDCQEEPDSCISEKLFMEPAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 418 - protein, 398 aa, Artificial Sequence
  Synthetic Polypeptide sequence of  Variant No. 377 of  mature Human GLA
LDNGLARTPTMGWLHWERFMCNLDCQEEPDSCISEKLFTEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 419 - protein, 398 aa, Artificial Sequence
  Synthetic Polypeptide sequence of  Variant No. 378 of  mature Human GLA
LDNGLARTPTMGWLHWERFMCNLDCQEEPDSCISEKLFMEMAETMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 420 - protein, 398 aa, Artificial Sequence
  Synthetic Polypeptide sequence of  Variant No. 379 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 421 - protein, 398 aa, Artificial Sequence
  Synthetic Polypeptide sequence of  Variant No. 380 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANKVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 422 - protein, 398 aa, Artificial Sequence
  Synthetic Polypeptide sequence of  Variant No. 381 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANSVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 423 - protein, 398 aa, Artificial Sequence
  Synthetic Polypeptide sequence of  Variant No. 382 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVNSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 424 - protein, 398 aa, Artificial Sequence
  Synthetic Polypeptide sequence of  Variant No. 383 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANCVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 425 - protein, 398 aa, Artificial Sequence
  Synthetic Polypeptide sequence of  Variant No. 384 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANVVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 426 - protein, 398 aa, Artificial Sequence
  Synthetic Polypeptide sequence of  Variant No. 385 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANAVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 427 - protein, 398 aa, Artificial Sequence
  Synthetic Polypeptide sequence of  Variant No. 386 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVRSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 428 - protein, 398 aa, Artificial Sequence
  Synthetic Polypeptide sequence of  Variant No. 387 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYTHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 429 - protein, 398 aa, Artificial Sequence
  Synthetic Polypeptide sequence of  Variant No. 388 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYLHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 430 - protein, 398 aa, Artificial Sequence
  Synthetic Polypeptide sequence of  Variant No. 389 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYSHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 431 - protein, 398 aa, Artificial Sequence
  Synthetic Polypeptide sequence of  Variant No. 390 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYQHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 432 - protein, 398 aa, Artificial Sequence
  Synthetic Polypeptide sequence of  Variant No. 391 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYWHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 433 - protein, 398 aa, Artificial Sequence; identical to SEQ ID NO: 428
  Synthetic Polypeptide sequence of  Variant No. 392 of  mature Human GLA

SEQ ID NO: 434 - protein, 398 aa, Artificial Sequence
  Synthetic Polypeptide sequence of  Variant No. 393 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYGHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 435 - protein, 398 aa, Artificial Sequence
  Synthetic Polypeptide sequence of  Variant No. 394 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYRHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 436 - skipped

SEQ ID NO: 437 - protein, 398 aa, Artificial Sequence
  Synthetic Polypeptide sequence of  Variant No. 396 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSMALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 438 - protein, 398 aa, Artificial Sequence
  Synthetic Polypeptide sequence of  Variant No. 397 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSRALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 439 - protein, 398 aa, Artificial Sequence
  Synthetic Polypeptide sequence of  Variant No. 398 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLSLNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 440 - protein, 398 aa, Artificial Sequence
  Synthetic Polypeptide sequence of  Variant No. 399 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGKSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 441 - protein, 398 aa, Artificial Sequence
  Synthetic Polypeptide sequence of  Variant No. 400 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSCALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 442 - protein, 398 aa, Artificial Sequence
  Synthetic Polypeptide sequence of  Variant No. 401 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRSGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 443 - skipped

SEQ ID NO: 444 - protein, 398 aa, Artificial Sequence
  Synthetic Polypeptide sequence of  Variant No. 403 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRGIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 445 - protein, 398 aa, Artificial Sequence
  Synthetic Polypeptide sequence of  Variant No. 404 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRFIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 446 - protein, 398 aa, Artificial Sequence
  Synthetic Polypeptide sequence of  Variant No. 405 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSEALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 447 - protein, 398 aa, Artificial Sequence
  Synthetic Polypeptide sequence of  Variant No. 406 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNKTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 448 - protein, 398 aa, Artificial Sequence
  Synthetic Polypeptide sequence of  Variant No. 407 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSHALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 449 - protein, 398 aa, Artificial Sequence
  Synthetic Polypeptide sequence of  Variant No. 408 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRRIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 450 - protein, 398 aa, Artificial Sequence
  Synthetic Polypeptide sequence of  Variant No. 409 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGHSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 451 - protein, 398 aa, Artificial Sequence
  Synthetic Polypeptide sequence of  Variant No. 410 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNHTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 452 - protein, 398 aa, Artificial Sequence
  Synthetic Polypeptide sequence of  Variant No. 411 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRAIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 453 - protein, 398 aa, Artificial Sequence
  Synthetic Polypeptide sequence of  Variant No. 412 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRHIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 454 - protein, 398 aa, Artificial Sequence
  Synthetic Polypeptide sequence of  Variant No. 413 of  mature Human GLA
  VARIANT (163)..(163): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRXGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 455 - protein, 398 aa, Artificial Sequence
  Synthetic Polypeptide sequence of  Variant No. 414 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSQALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 456 - protein, 398 aa, Artificial Sequence
  Synthetic Polypeptide sequence of  Variant No. 415 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRDIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 457 - protein, 398 aa, Artificial Sequence
  Synthetic Polypeptide sequence of  Variant No. 416 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNGTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 458 - protein, 398 aa, Artificial Sequence
  Synthetic Polypeptide sequence of  Variant No. 417 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNSTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 459 - protein, 398 aa, Artificial Sequence
  Synthetic Polypeptide sequence of  Variant No. 418 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALERTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 460 - protein, 398 aa, Artificial Sequence
  Synthetic Polypeptide sequence of  Variant No. 419 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGREIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 461 - protein, 398 aa, Artificial Sequence
  Synthetic Polypeptide sequence of  Variant No. 420 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRTIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 462 - protein, 398 aa, Artificial Sequence
  Synthetic Polypeptide sequence of  Variant No. 421 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNQTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 463 - protein, 398 aa, Artificial Sequence
  Synthetic Polypeptide sequence of  Variant No. 422 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSGALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 464 - protein, 398 aa, Artificial Sequence
  Synthetic Polypeptide sequence of Variant No. 423 of mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNATGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 465 - protein, 398 aa, Artificial Sequence
  Synthetic Polypeptide sequence of  Variant No. 424 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMAEWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 466 - protein, 398 aa, Artificial Sequence
  Synthetic Polypeptide sequence of  Variant No. 425 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLREISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 467 - protein, 398 aa, Artificial Sequence
  Synthetic Polypeptide sequence of  Variant No. 426 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIEAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 468 - protein, 398 aa, Artificial Sequence
  Synthetic Polypeptide sequence of  Variant No. 427 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPGFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 469 - protein, 398 aa, Artificial Sequence
  Synthetic Polypeptide sequence of  Variant No. 428 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAISAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 470 - protein, 398 aa, Artificial Sequence
  Synthetic Polypeptide sequence of  Variant No. 429 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMACWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 471 - protein, 398 aa, Artificial Sequence
  Synthetic Polypeptide sequence of  Variant No. 430 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRTISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 472 - protein, 398 aa, Artificial Sequence
  Synthetic Polypeptide sequence of  Variant No. 431 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLGHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 473 - protein, 398 aa, Artificial Sequence
  Synthetic Polypeptide sequence of  Variant No. 432 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 474 - protein, 398 aa, Artificial Sequence
  Synthetic Polypeptide sequence of  Variant No. 433 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRQISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 475 - protein, 398 aa, Artificial Sequence
  Synthetic Polypeptide sequence of  Variant No. 434 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLDHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 476 - protein, 398 aa, Artificial Sequence
  Synthetic Polypeptide sequence of  Variant No. 435 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWALMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 477 - protein, 398 aa, Artificial Sequence
  Synthetic Polypeptide sequence of  Variant No. 436 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRGISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 478 - protein, 398 aa, Artificial Sequence
  Synthetic Polypeptide sequence of  Variant No. 437 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPEFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 479 - protein, 398 aa, Artificial Sequence
  Synthetic Polypeptide sequence of  Variant No. 438 of  mature Human GLA
  VARIANT (255)..(255): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMAXWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 480 - protein, 398 aa, Artificial Sequence
  Synthetic Polypeptide sequence of  Variant No. 439 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 481 - protein, 398 aa, Artificial Sequence
  Synthetic Polypeptide sequence of  Variant No. 440 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPCFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 482 - protein, 398 aa, Artificial Sequence
  Synthetic Polypeptide sequence of  Variant No. 441 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRVISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 483 - protein, 398 aa, Artificial Sequence
  Synthetic Polypeptide sequence of  Variant No. 442 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMAAWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 484 - protein, 398 aa, Artificial Sequence
  Synthetic Polypeptide sequence of  Variant No. 443 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMASWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 485 - protein, 398 aa, Artificial Sequence
  Synthetic Polypeptide sequence of  Variant No. 444 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIWAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 486 - protein, 398 aa, Artificial Sequence
  Synthetic Polypeptide sequence of  Variant No. 445 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPFFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 487 - protein, 398 aa, Artificial Sequence
  Synthetic Polypeptide sequence of  Variant No. 446 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIAAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 488 - protein, 398 aa, Artificial Sequence
  Synthetic Polypeptide sequence of  Variant No. 447 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPWFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 489 - protein, 398 aa, Artificial Sequence
  Synthetic Polypeptide sequence of  Variant No. 448 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLQHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 490 - protein, 398 aa, Artificial Sequence
  Synthetic Polypeptide sequence of  Variant No. 449 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMATWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 491 - protein, 398 aa, Artificial Sequence
  Synthetic Polypeptide sequence of  Variant No. 450 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAMMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 492 - protein, 398 aa, Artificial Sequence
  Synthetic Polypeptide sequence of  Variant No. 451 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIVAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 493 - protein, 398 aa, Artificial Sequence
  Synthetic Polypeptide sequence of  Variant No. 452 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRRISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 494 - protein, 398 aa, Artificial Sequence
  Synthetic Polypeptide sequence of  Variant No. 453 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLLHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 495 - protein, 398 aa, Artificial Sequence
  Synthetic Polypeptide sequence of  Variant No. 454 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTPQMSLKDLL

SEQ ID NO: 496 - protein, 398 aa, Artificial Sequence
  Synthetic Polypeptide sequence of  Variant No. 455 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQDSLKDLL

SEQ ID NO: 497 - protein, 398 aa, Artificial Sequence
  Synthetic Polypeptide sequence of  Variant No. 456 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENMMQMSLKDLL

SEQ ID NO: 498 - protein, 398 aa, Artificial Sequence
  Synthetic Polypeptide sequence of  Variant No. 457 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQASLKDLL

SEQ ID NO: 499 - protein, 398 aa, Artificial Sequence
  Synthetic Polypeptide sequence of  Variant No. 458 of  mature Human GLA
  VARIANT (390)..(390): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTXQMSLKDLL

SEQ ID NO: 500 - protein, 398 aa, Artificial Sequence
  Synthetic Polypeptide sequence of  Variant No. 459 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQMSLKDLL

SEQ ID NO: 501 - protein, 398 aa, Artificial Sequence
  Synthetic Polypeptide sequence of  Variant No. 460 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQTENTMQMSLKDLL

SEQ ID NO: 502 - protein, 398 aa, Artificial Sequence
  Synthetic Polypeptide sequence of  Variant No. 461 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQQSLKDLL

SEQ ID NO: 503 - protein, 398 aa, Artificial Sequence
  Synthetic Polypeptide sequence of  Variant No. 462 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLLLENTMQMSLKDLL

SEQ ID NO: 504 - protein, 398 aa, Artificial Sequence
  Synthetic Polypeptide sequence of  Variant No. 463 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTTQMSLKDLL

SEQ ID NO: 505 - protein, 398 aa, Artificial Sequence
  Synthetic Polypeptide sequence of  Variant No. 464 of  mature Human GLA
  VARIANT (392)..(392): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQXSLKDLL

SEQ ID NO: 506 - protein, 398 aa, Artificial Sequence
  Synthetic Polypeptide sequence of  Variant No. 465 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 507 - protein, 398 aa, Artificial Sequence
  Synthetic Polypeptide sequence of  Variant No. 466 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQESLKDLL

SEQ ID NO: 508 - protein, 398 aa, Artificial Sequence
  Synthetic Polypeptide sequence of  Variant No. 467 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENSMQMSLKDLL

SEQ ID NO: 509 - protein, 398 aa, Artificial Sequence
  Synthetic Polypeptide sequence of  Variant No. 468 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENQMQMSLKDLL

SEQ ID NO: 510 - protein, 398 aa, Artificial Sequence
  Synthetic Polypeptide sequence of  Variant No. 469 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLILENTMQMSLKDLL

SEQ ID NO: 511 - protein, 398 aa, Artificial Sequence
  Synthetic Polypeptide sequence of  Variant No. 470 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQRSLKDLL

SEQ ID NO: 512 - protein, 398 aa, Artificial Sequence
  Synthetic Polypeptide sequence of  Variant No. 471 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENWMQMSLKDLL

SEQ ID NO: 513 - protein, 398 aa, Artificial Sequence
  Synthetic Polypeptide sequence of  Variant No. 472 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQKSLKDLL

SEQ ID NO: 514 - protein, 398 aa, Artificial Sequence
  Synthetic Polypeptide sequence of  Variant No. 473 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQLSLKDLL

SEQ ID NO: 515 - protein, 398 aa, Artificial Sequence
  Synthetic Polypeptide sequence of  Variant No. 474 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQFENTMQMSLKDLL

SEQ ID NO: 516 - protein, 398 aa, Artificial Sequence
  Synthetic Polypeptide sequence of  Variant No. 475 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENDMQMSLKDLL

SEQ ID NO: 517 - protein, 398 aa, Artificial Sequence
  Synthetic Polypeptide sequence of  Variant No. 476 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTEQMSLKDLL

SEQ ID NO: 518 - protein, 398 aa, Artificial Sequence
  Synthetic Polypeptide sequence of  Variant No. 477 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLWQLENTMQMSLKDLL

SEQ ID NO: 519 - protein, 398 aa, Artificial Sequence
  Synthetic Polypeptide sequence of  Variant No. 478 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQSSLKDLL

SEQ ID NO: 520 - protein, 398 aa, Artificial Sequence
  Synthetic Polypeptide sequence of  Variant No. 479 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQFSLKDLL

SEQ ID NO: 521 - protein, 398 aa, Artificial Sequence
  Synthetic Polypeptide sequence of  Variant No. 480 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTRQMSLKDLL

SEQ ID NO: 522 - protein, 398 aa, Artificial Sequence
  Synthetic Polypeptide sequence of  Variant No. 481 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTGQMSLKDLL

SEQ ID NO: 523 - protein, 398 aa, Artificial Sequence
  Synthetic Polypeptide sequence of  Variant No. 482 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLGLENTMQMSLKDLL

SEQ ID NO: 524 - protein, 398 aa, Artificial Sequence
  Synthetic Polypeptide sequence of  Variant No. 483 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQCSLKDLL

SEQ ID NO: 525 - protein, 398 aa, Artificial Sequence
  Synthetic Polypeptide sequence of  Variant No. 484 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQVSLKDLL

SEQ ID NO: 526 - protein, 398 aa, Artificial Sequence
  Synthetic Polypeptide sequence of  Variant No. 485 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQWSLKDLL

SEQ ID NO: 527 - protein, 398 aa, Artificial Sequence
  Synthetic Polypeptide sequence of  Variant No. 486 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTCQMSLKDLL

SEQ ID NO: 528 - protein, 398 aa, Artificial Sequence
  Synthetic Polypeptide sequence of  Variant No. 487 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENGMQMSLKDLL

SEQ ID NO: 529 - protein, 398 aa, Artificial Sequence
  Synthetic Polypeptide sequence of  Variant No. 488 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENNMQMSLKDLL

SEQ ID NO: 530 - protein, 398 aa, Artificial Sequence
  Synthetic Polypeptide sequence of  Variant No. 489 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENIMQMSLKDLL

SEQ ID NO: 531 - protein, 398 aa, Artificial Sequence
  Synthetic Polypeptide sequence of  Variant No. 490 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTDQMSLKDLL

SEQ ID NO: 532 - protein, 398 aa, Artificial Sequence
  Synthetic Polypeptide sequence of  Variant No. 491 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTWQMSLKDLL

SEQ ID NO: 533 - protein, 398 aa, Artificial Sequence
  Synthetic Polypeptide sequence of  Variant No. 492 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENCMQMSLKDLL

SEQ ID NO: 534 - protein, 398 aa, Artificial Sequence
  Synthetic Polypeptide sequence of  Variant No. 493 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQPSLKDLL

SEQ ID NO: 535 - protein, 398 aa, Artificial Sequence
  Synthetic Polypeptide sequence of  Variant No. 494 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTFQMSLKDLL

SEQ ID NO: 536 - protein, 398 aa, Artificial Sequence
  Synthetic Polypeptide sequence of  Variant No. 495 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENPMQMSLKDLL

SEQ ID NO: 537 - protein, 398 aa, Artificial Sequence
  Synthetic Polypeptide sequence of  Variant No. 496 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTVQMSLKDLL

SEQ ID NO: 538 - protein, 398 aa, Artificial Sequence
  Synthetic Polypeptide sequence of  Variant No. 497 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTKQMSLKDLL

SEQ ID NO: 539 - protein, 398 aa, Artificial Sequence
  Synthetic Polypeptide sequence of  Variant No. 498 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQISLKDLL

SEQ ID NO: 540 - protein, 398 aa, Artificial Sequence
  Synthetic Polypeptide sequence of  Variant No. 499 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENLMQMSLKDLL

SEQ ID NO: 541 - protein, 398 aa, Artificial Sequence
  Synthetic Polypeptide sequence of  Variant No. 500 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTAQMSLKDLL

SEQ ID NO: 542 - protein, 398 aa, Artificial Sequence
  Synthetic Polypeptide sequence of  Variant No. 501 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQGSLKDLL

SEQ ID NO: 543 - protein, 398 aa, Artificial Sequence
  Synthetic Polypeptide sequence of  Variant No. 502 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQSENTMQMSLKDLL

SEQ ID NO: 544 - protein, 398 aa, Artificial Sequence
  Synthetic Polypeptide sequence of  Variant No. 503 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLCLENTMQMSLKDLL

SEQ ID NO: 545 - protein, 398 aa, Artificial Sequence
  Synthetic Polypeptide sequence of  Variant No. 504 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTSQMSLKDLL

SEQ ID NO: 546 - protein, 398 aa, Artificial Sequence
  Synthetic Polypeptide sequence of  Variant No. 505 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQNSLKDLL

SEQ ID NO: 547 - protein, 398 aa, Artificial Sequence
  Synthetic Polypeptide sequence of  Variant No. 506 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLWLENTMQMSLKDLL

SEQ ID NO: 548 - protein, 398 aa, Artificial Sequence
  Synthetic Polypeptide sequence of  Variant No. 507 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQTSLKDLL

SEQ ID NO: 549 - protein, 398 aa, Artificial Sequence
  Synthetic Polypeptide sequence of  Variant No. 508 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLAQLENTMQMSLKDLL

SEQ ID NO: 550 - protein, 398 aa, Artificial Sequence
  Synthetic Polypeptide sequence of  Variant No. 509 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLTLENTMQMSLKDLL

SEQ ID NO: 551 - protein, 398 aa, Artificial Sequence
  Synthetic Polypeptide sequence of  Variant No. 510 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFGDIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQRSLKDLL

SEQ ID NO: 552 - protein, 398 aa, Artificial Sequence
  Synthetic Polypeptide sequence of  Variant No. 511 of  mature Human GLA
  VARIANT (397)..(397): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDXL

SEQ ID NO: 553 - protein, 398 aa, Artificial Sequence
  Synthetic Polypeptide sequence of  Variant No. 512 of  mature Human GLA
  VARIANT (395)..(395): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLXDLL

SEQ ID NO: 554 - protein, 398 aa, Artificial Sequence
  Synthetic Polypeptide sequence of  Variant No. 513 of  mature Human GLA
  VARIANT (396)..(396): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKXLL

SEQ ID NO: 555 - protein, 398 aa, Artificial Sequence
  Synthetic Polypeptide sequence of  Variant No. 514 of  mature Human GLA
  VARIANT (393)..(393): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMXLKDLL

SEQ ID NO: 556 - protein, 398 aa, Artificial Sequence
  Synthetic Polypeptide sequence of  Variant No. 515 of  mature Human GLA
  VARIANT (394)..(394): Xaa = any amino acid
LDNGLARTPTMGWLHWERFMCNLDCQEEPDSCISEKLFMEMAERMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSXKDLL

SEQ ID NO: 557 - protein, 398 aa, Artificial Sequence
  Synthetic Polypeptide sequence of  Variant No. 516 of  mature Human GLA
LENGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRGEIGGPRSYTIPVASLGKGVACNPACFITQLLPVKRQLGFYNWTSRLKSHINPTGTVLLQLENTMQMSLKDLL

SEQ ID NO: 558 - protein, 398 aa, Artificial Sequence
  Synthetic Polypeptide sequence of  Variant No. 517 of  mature Human GLA
LQNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 559 - protein, 398 aa, Artificial Sequence
  Synthetic Polypeptide sequence of  Variant No. 518 of  mature Human GLA
LDNGLARTPTMGWLHWERFMCNLDCQEEPDSCISEKLFMDMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 560 - protein, 398 aa, Artificial Sequence
  Synthetic Polypeptide sequence of  Variant No. 519 of  mature Human GLA
LDNGLARTPTMGWLHWERFMCNLDCQEEPDSCISEKLFMSMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 561 - protein, 398 aa, Artificial Sequence
  Synthetic Polypeptide sequence of  Variant No. 520 of  mature Human GLA
LDNGLARTPTMGWLHWERFMCNLDCQEEPDSCISEKLFMEMAERMVSEGWKDAGYEYLCIDDCWMAPQRDSEGRLQSDPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 562 - protein, 398 aa, Artificial Sequence
  Synthetic Polypeptide sequence of  Variant No. 521 of  mature Human GLA
LDNGLARTPTMGWLHWERFMCNLDCQEEPDSCISEKLFMEMAERMVSEGWKNAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 563 - protein, 398 aa, Artificial Sequence
  Synthetic Polypeptide sequence of  Variant No. 522 of  mature Human GLA
LDNGLARTPTMGWLHWERFMCNLDCQEEPDSCISEKLFMEMAERMVSEGWKDAGYKYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 564 - protein, 398 aa, Artificial Sequence
  Synthetic Polypeptide sequence of  Variant No. 523 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLAMHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 565 - protein, 398 aa, Artificial Sequence
  Synthetic Polypeptide sequence of  Variant No. 524 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLAVHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 566 - protein, 398 aa, Artificial Sequence
  Synthetic Polypeptide sequence of  Variant No. 525 of  mature Human GLA
LDNGLARTPTMGWLHWERFMCNLDCQEEPDSCISEKLFMEMAERMVSEGWKDAGYEYLCIDDCWMAPQRDSEGRLHADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQMSLKDLL

SEQ ID NO: 567 - protein, 398 aa, Artificial Sequence
  Synthetic Polypeptide sequence of  Variant No. 526 of  mature Human GLA
LDNGLARTPTMGWLHWERFMCNLDCQEEPDSCISEKLFMEMAERMVSEGWKDAGYEYLCIDDCWMAPQRDSEGHLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 568 - protein, 398 aa, Artificial Sequence
  Synthetic Polypeptide sequence of  Variant No. 527 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANEVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 569 - protein, 398 aa, Artificial Sequence
  Synthetic Polypeptide sequence of  Variant No. 528  of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFAQWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 570 - protein, 398 aa, Artificial Sequence
  Synthetic Polypeptide sequence of  Variant No. 529 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQAPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 571 - protein, 398 aa, Artificial Sequence
  Synthetic Polypeptide sequence of  Variant No. 530 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQEPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 572 - protein, 398 aa, Artificial Sequence
  Synthetic Polypeptide sequence of  Variant No. 531 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQHPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 573 - protein, 398 aa, Artificial Sequence
  Synthetic Polypeptide sequence of  Variant No. 532 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQMPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 574 - protein, 398 aa, Artificial Sequence
  Synthetic Polypeptide sequence of  Variant No. 533 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQQPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 575 - protein, 398 aa, Artificial Sequence
  Synthetic Polypeptide sequence of  Variant No. 534 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQRPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 576 - protein, 398 aa, Artificial Sequence
  Synthetic Polypeptide sequence of  Variant No. 535 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQTPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 577 - protein, 398 aa, Artificial Sequence
  Synthetic Polypeptide sequence of  Variant No. 536 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQVPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 578 - protein, 398 aa, Artificial Sequence
  Synthetic Polypeptide sequence of  Variant No. 537 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQYPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 579 - protein, 398 aa, Artificial Sequence
  Synthetic Polypeptide sequence of  Variant No. 538 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVICINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 580 - protein, 398 aa, Artificial Sequence
  Synthetic Polypeptide sequence of  Variant No. 539 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIHINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 581 - protein, 398 aa, Artificial Sequence
  Synthetic Polypeptide sequence of  Variant No. 540 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIMINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 582 - protein, 398 aa, Artificial Sequence
  Synthetic Polypeptide sequence of  Variant No. 541 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQAKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 583 - protein, 398 aa, Artificial Sequence
  Synthetic Polypeptide sequence of  Variant No. 542 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQGKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 584 - protein, 398 aa, Artificial Sequence
  Synthetic Polypeptide sequence of  Variant No. 543 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQMKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 585 - protein, 398 aa, Artificial Sequence
  Synthetic Polypeptide sequence of  Variant No. 544 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQVKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 586 - protein, 398 aa, Artificial Sequence
  Synthetic Polypeptide sequence of  Variant No. 545 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGAQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 587 - protein, 398 aa, Artificial Sequence
  Synthetic Polypeptide sequence of  Variant No. 546 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGEQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 588 - protein, 398 aa, Artificial Sequence
  Synthetic Polypeptide sequence of  Variant No. 547 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGLQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 589 - protein, 398 aa, Artificial Sequence
  Synthetic Polypeptide sequence of  Variant No. 548 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGNQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 590 - protein, 398 aa, Artificial Sequence
  Synthetic Polypeptide sequence of  Variant No. 549 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGQQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 591 - protein, 398 aa, Artificial Sequence
  Synthetic Polypeptide sequence of  Variant No. 550 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGSQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 592 - protein, 398 aa, Artificial Sequence
  Synthetic Polypeptide sequence of  Variant No. 551 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGTQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 593 - protein, 398 aa, Artificial Sequence
  Synthetic Polypeptide sequence of  Variant No. 552 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDDWAVAIINRQEIGGPRSYTIPVASLGKGVACNPACFITQLLPVKRQLGFYNWTSRLKSHINPTGTVLLQLENTMQMSLKDLL

SEQ ID NO: 594 - protein, 398 aa, Artificial Sequence
  Synthetic Polypeptide sequence of  Variant No. 553 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDQWAVAIINRQEIGGPRSYTIPVASLGKGVACNPACFITQLLPVKRQLGFYNWTSRLKSHINPTGTVLLQLENTMQMSLKDLL

SEQ ID NO: 595 - protein, 398 aa, Artificial Sequence
  Synthetic Polypeptide sequence of  Variant No. 554 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVGCNPACFITQLLPVKRQLGFYNWTSRLKSHINPTGTVLLQLENTMQMSLKDLL

SEQ ID NO: 596 - protein, 398 aa, Artificial Sequence
  Synthetic Polypeptide sequence of  Variant No. 555 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKAVACNPACFITQLLPVKRQLGFYNWTSRLKSHINPTGTVLLQLENTMQMSLKDLL

SEQ ID NO: 597 - protein, 398 aa, Artificial Sequence
  Synthetic Polypeptide sequence of  Variant No. 556 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKDVACNPACFITQLLPVKRQLGFYNWTSRLKSHINPTGTVLLQLENTMQMSLKDLL

SEQ ID NO: 598 - protein, 398 aa, Artificial Sequence
  Synthetic Polypeptide sequence of  Variant No. 557 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKSVACNPACFITQLLPVKRQLGFYNWTSRLKSHINPTGTVLLQLENTMQMSLKDLL

SEQ ID NO: 599 - protein, 398 aa, Artificial Sequence
  Synthetic Polypeptide sequence of  Variant No. 558 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFLTQLLPVKRQLGFYNWTSRLKSHINPTGTVLLQLENTMQMSLKDLL

SEQ ID NO: 600 - protein, 398 aa, Artificial Sequence
  Synthetic Polypeptide sequence of  Variant No. 559 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRWKSHINPTGTVLLQLENTMQMSLKDLL

SEQ ID NO: 601 - protein, 398 aa, Artificial Sequence
  Synthetic Polypeptide sequence of  Variant No. 560 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQMSLKDLL

SEQ ID NO: 602 - protein, 398 aa, Artificial Sequence
  Synthetic Polypeptide sequence of  Variant No. 561 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNLTSRLKSHINPTGTVLLQLENTMQMSLKDLL

SEQ ID NO: 603 - protein, 398 aa, Artificial Sequence
  Synthetic Polypeptide sequence of  Variant No. 562 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNNTSRLKSHINPTGTVLLQLENTMQMSLKDLL

SEQ ID NO: 604 - protein, 398 aa, Artificial Sequence
  Synthetic Polypeptide sequence of  Variant No. 563 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNRTSRLKSHINPTGTVLLQLENTMQMSLKDLL

SEQ ID NO: 605 - protein, 398 aa, Artificial Sequence
  Synthetic Polypeptide sequence of  Variant No. 564 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNVTSRLKSHINPTGTVLLQLENTMQMSLKDLL

SEQ ID NO: 606 - protein, 398 aa, Artificial Sequence
  Synthetic Polypeptide sequence of  Variant No. 565 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACEPACFITQLLPVKRQLGFYNWTSRLKSHINPTGTVLLQLENTMQMSLKDLL

SEQ ID NO: 607 - protein, 398 aa, Artificial Sequence
  Synthetic Polypeptide sequence of  Variant No. 566 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACMPACFITQLLPVKRQLGFYNWTSRLKSHINPTGTVLLQLENTMQMSLKDLL

SEQ ID NO: 608 - protein, 398 aa, Artificial Sequence
  Synthetic Polypeptide sequence of  Variant No. 567 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACQPACFITQLLPVKRQLGFYNWTSRLKSHINPTGTVLLQLENTMQMSLKDLL

SEQ ID NO: 609 - protein, 398 aa, Artificial Sequence
  Synthetic Polypeptide sequence of  Variant No. 568 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACRPACFITQLLPVKRQLGFYNWTSRLKSHINPTGTVLLQLENTMQMSLKDLL

SEQ ID NO: 610 - protein, 398 aa, Artificial Sequence
  Synthetic Polypeptide sequence of  Variant No. 569 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACWPACFITQLLPVKRQLGFYNWTSRLKSHINPTGTVLLQLENTMQMSLKDLL

SEQ ID NO: 611 - protein, 398 aa, Artificial Sequence
  Synthetic Polypeptide sequence of  Variant No. 570 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFISQLLPVKRQLGFYNWTSRLKSHINPTGTVLLQLENTMQMSLKDLL

SEQ ID NO: 612 - protein, 398 aa, Artificial Sequence
  Synthetic Polypeptide sequence of  Variant No. 571 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDKFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 613 - protein, 398 aa, Artificial Sequence
  Synthetic Polypeptide sequence of  Variant No. 572 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDLFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 614 - protein, 398 aa, Artificial Sequence
  Synthetic Polypeptide sequence of  Variant No. 573 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLAGDAWAVAIINRQEIGGPRSYTIPVASLGKGVACNPACFITQLLPVKRQLGFYNWTSRLKSHINPTGTVLLQLENTMQMSLKDLL

SEQ ID NO: 615 - protein, 398 aa, Artificial Sequence
  Synthetic Polypeptide sequence of  Variant No. 574 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLHGDAWAVAIINRQEIGGPRSYTIPVASLGKGVACNPACFITQLLPVKRQLGFYNWTSRLKSHINPTGTVLLQLENTMQMSLKDLL

SEQ ID NO: 616 - protein, 398 aa, Artificial Sequence
  Synthetic Polypeptide sequence of  Variant No. 575 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLNGDAWAVAIINRQEIGGPRSYTIPVASLGKGVACNPACFITQLLPVKRQLGFYNWTSRLKSHINPTGTVLLQLENTMQMSLKDLL

SEQ ID NO: 617 - protein, 398 aa, Artificial Sequence
  Synthetic Polypeptide sequence of  Variant No. 576 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLYGDAWAVAIINRQEIGGPRSYTIPVASLGKGVACNPACFITQLLPVKRQLGFYNWTSRLKSHINPTGTVLLQLENTMQMSLKDLL

SEQ ID NO: 618 - protein, 398 aa, Artificial Sequence
  Synthetic Polypeptide sequence of  Variant No. 577 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSADQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 619 - protein, 398 aa, Artificial Sequence
  Synthetic Polypeptide sequence of  Variant No. 578 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSIDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 620 - protein, 398 aa, Artificial Sequence
  Synthetic Polypeptide sequence of  Variant No. 579 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSPDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 621 - protein, 398 aa, Artificial Sequence
  Synthetic Polypeptide sequence of  Variant No. 580 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSRDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 622 - protein, 398 aa, Artificial Sequence
  Synthetic Polypeptide sequence of  Variant No. 581 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSSDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 623 - protein, 398 aa, Artificial Sequence
  Synthetic Polypeptide sequence of  Variant No. 582 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKAILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 624 - protein, 398 aa, Artificial Sequence
  Synthetic Polypeptide sequence of  Variant No. 583 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKAILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPTCFITQLLPVKRQLGFYNWTSRLKSHINPTGTVLLQLENTMQMSLKDLL

SEQ ID NO: 625 - protein, 398 aa, Artificial Sequence
  Synthetic Polypeptide sequence of  Variant No. 584 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKEILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 626 - protein, 398 aa, Artificial Sequence
  Synthetic Polypeptide sequence of Variant No. 585 of mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKKILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 627 - protein, 398 aa, Artificial Sequence
  Synthetic Polypeptide sequence of  Variant No. 586 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKNILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 628 - protein, 398 aa, Artificial Sequence
  Synthetic Polypeptide sequence of  Variant No. 587 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKRILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 629 - protein, 398 aa, Artificial Sequence
  Synthetic Polypeptide sequence of  Variant No. 588 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSAGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 630 - protein, 398 aa, Artificial Sequence
  Synthetic Polypeptide sequence of  Variant No. 589 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSWGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 631 - protein, 398 aa, Artificial Sequence
  Synthetic Polypeptide sequence of  Variant No. 590 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWMFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 632 - protein, 398 aa, Artificial Sequence
  Synthetic Polypeptide sequence of  Variant No. 591 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIKQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 633 - protein, 398 aa, Artificial Sequence
  Synthetic Polypeptide sequence of  Variant No. 592 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIVQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 634 - protein, 398 aa, Artificial Sequence
  Synthetic Polypeptide sequence of  Variant No. 593 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHAKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 635 - protein, 398 aa, Artificial Sequence
  Synthetic Polypeptide sequence of  Variant No. 594 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHEKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 636 - protein, 398 aa, Artificial Sequence
  Synthetic Polypeptide sequence of  Variant No. 595 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYAEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 637 - protein, 398 aa, Artificial Sequence
  Synthetic Polypeptide sequence of  Variant No. 596 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYGEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 638 - protein, 398 aa, Artificial Sequence
  Synthetic Polypeptide sequence of  Variant No. 597 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYVEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 639 - protein, 398 aa, Artificial Sequence
  Synthetic Polypeptide sequence of  Variant No. 598 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGHYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 640 - protein, 398 aa, Artificial Sequence
  Synthetic Polypeptide sequence of  Variant No. 599 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGSYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 641 - protein, 398 aa, Artificial Sequence
  Synthetic Polypeptide sequence of  Variant No. 600 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGSYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASFGKGVACNPACFITQLLPVKRQLGFYNWTSRLKSHINPTGTVLLQLENTMQMSLKDLL

SEQ ID NO: 642 - protein, 398 aa, Artificial Sequence
  Synthetic Polypeptide sequence of  Variant No. 601 of  mature Human GLA
LDNGLARTPTMGWLHWERFMCNLDCQEEPDSCISEKLFCEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 643 - protein, 398 aa, Artificial Sequence
  Synthetic Polypeptide sequence of  Variant No. 602 of  mature Human GLA
LDNGLARTPTMGWLHWERFMCNLDCQEEPDSCISEKLFEEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 644 - protein, 398 aa, Artificial Sequence
  Synthetic Polypeptide sequence of  Variant No. 603 of  mature Human GLA
LDNGLARTPTMGWLHWERFMCNLDCQEEPDSCISEKLFREMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 645 - protein, 398 aa, Artificial Sequence
  Synthetic Polypeptide sequence of  Variant No. 604 of  mature Human GLA
LDNGLARTPTMGWLHWERFMCNLDCQEEPDSCISEKLFVEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 646 - protein, 398 aa, Artificial Sequence
  Synthetic Polypeptide sequence of  Variant No. 605 of  mature Human GLA
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 647 - protein, 398 aa, Artificial Sequence
  Synthetic Polypeptide sequence of  Variant No. 606 of  mature Human GLA
LDNGLARTPPMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEILQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 648 - protein, 398 aa, Artificial Sequence
  Synthetic Polypeptide sequence of  Variant No. 607 of  mature Human GLA
LDNGLARLPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 649 - protein, 398 aa, Artificial Sequence
  Synthetic Polypeptide sequence of  Variant No. 608 of  mature Human GLA
LDNGLARQPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 650 - protein, 398 aa, Artificial Sequence; identical to SEQ ID NO: 42
  Synthetic Polypeptide sequence of  Variant No. 609 of  mature Human GLA

SEQ ID NO: 651 - protein, 398 aa, Artificial Sequence
  Synthetic Polypeptide sequence of  Variant No. 610 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIEAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 652 - protein, 398 aa, Artificial Sequence
  Synthetic Polypeptide sequence of  Variant No. 611 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 653 - protein, 398 aa, Artificial Sequence
  Synthetic Polypeptide sequence of  Variant No. 612 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 654 - protein, 398 aa, Artificial Sequence
  Synthetic Polypeptide sequence of  Variant No. 613 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 655 - protein, 398 aa, Artificial Sequence
  Synthetic Polypeptide sequence of  Variant No. 614 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 656 - protein, 398 aa, Artificial Sequence
  Synthetic Polypeptide sequence of  Variant No. 615 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQMSLKDLL

SEQ ID NO: 657 - protein, 398 aa, Artificial Sequence
  Synthetic Polypeptide sequence of  Variant No. 616 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIWAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 658 - protein, 398 aa, Artificial Sequence
  Synthetic Polypeptide sequence of  Variant No. 617 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLVKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIAAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 659 - protein, 398 aa, Artificial Sequence
  Synthetic Polypeptide sequence of  Variant No. 618 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 660 - protein, 398 aa, Artificial Sequence
  Synthetic Polypeptide sequence of  Variant No. 619 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQMSLKDLL

SEQ ID NO: 661 - protein, 398 aa, Artificial Sequence
  Synthetic Polypeptide sequence of  Variant No. 620 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 662 - protein, 398 aa, Artificial Sequence
  Synthetic Polypeptide sequence of  Variant No. 621 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIEAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 663 - protein, 398 aa, Artificial Sequence
  Synthetic Polypeptide sequence of  Variant No. 622 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIWAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQTSLKDLL

SEQ ID NO: 664 - protein, 398 aa, Artificial Sequence
  Synthetic Polypeptide sequence of  Variant No. 623 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQSKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 665 - protein, 398 aa, Artificial Sequence
  Synthetic Polypeptide sequence of  Variant No. 624 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 666 - protein, 398 aa, Artificial Sequence
  Synthetic Polypeptide sequence of  Variant No. 626 of  mature Human GLA
LDNGLARTPTMGWLHWERFMCNLDCQEEPDSCISEKLFMEMAERMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 667 - protein, 398 aa, Artificial Sequence
  Synthetic Polypeptide sequence of  Variant No. 627 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIWAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQTSLKDLL

SEQ ID NO: 668 - protein, 398 aa, Artificial Sequence
  Synthetic Polypeptide sequence of  Variant No. 628 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQMSLKDLL

SEQ ID NO: 669 - protein, 398 aa, Artificial Sequence
  Synthetic Polypeptide sequence of  Variant No. 629 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTQQMSLKDLL

SEQ ID NO: 670 - protein, 398 aa, Artificial Sequence
  Synthetic Polypeptide sequence of  Variant No. 630 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIWAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTHQMSLKDLL

SEQ ID NO: 671 - protein, 398 aa, Artificial Sequence; identical to SEQ ID NO: 661
  Synthetic Polypeptide sequence of  Variant No. 631 of  mature Human GLA

SEQ ID NO: 672 - protein, 398 aa, Artificial Sequence
  Synthetic Polypeptide sequence of  Variant No. 632 of  mature Human GLA
LDNGLARTPTMGWLHWERFMCNLDCQEEPDSCISEKLFMEMAERMVNEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 673 - protein, 398 aa, Artificial Sequence
  Synthetic Polypeptide sequence of  Variant No. 633 of  mature Human GLA
LDNGLARTPTMGWLHWERFMCNLDCQEEPDSCISEKLFMEMADRMVSEGWKDAGYEYLCIDDCWMAPQRDSEGRLQADPQRFPHGIRQLANSVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 674 - protein, 398 aa, Artificial Sequence
  Synthetic Polypeptide sequence of  Variant No. 634 of  mature Human GLA
LDNGLARTPTMGWLHWERFMCNLDCQEEPDSCISEKLFMEMADRMVSEGWKDAGYEYLCIDDCWMAPQRDSEGRLQADPQRFPHGIRQLANEVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 675 - protein, 398 aa, Artificial Sequence
  Synthetic Polypeptide sequence of  Variant No. 635 of  mature Human GLA
LDNGLARTPTMGWLHWERFMCNLDCQEEPDSCISEKLFMEMADRMVSEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 676 - protein, 398 aa, Artificial Sequence
  Synthetic Polypeptide sequence of  Variant No. 636 of  mature Human GLA
LDNGLARTPTMGWLHWERFMCNLDCQEEPDSCISEKLFMEMADRMVSEGWKDAGYEYLCIDDCWMAPQRDSEGRLQADPQRFPHGIRQLANNVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 677 - protein, 398 aa, Artificial Sequence
  Synthetic Polypeptide sequence of  Variant No. 637 of  mature Human GLA
LDNGLARTPTMGWLHWERFMCNLDCQEEPDSCISEKLFMEMAQLMVSEGWKDAGYEYLCIDDCWMAPQRDSEGRLQADPQRFPHGIRQLANEVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRHISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQMSLKDLL

SEQ ID NO: 678 - protein, 398 aa, Artificial Sequence
  Synthetic Polypeptide sequence of  Variant No. 638 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 679 - protein, 398 aa, Artificial Sequence
  Synthetic Polypeptide sequence of  Variant No. 639 of  mature Human GLA
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWYQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 680 - protein, 398 aa, Artificial Sequence
  Synthetic Polypeptide sequence of  Variant No. 640 of  mature Human GLA
LDNGLARTPPMGWLHWERFMCNLDCQEEPDSCISEKLFEEMADRMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 681 - protein, 398 aa, Artificial Sequence
  Synthetic Polypeptide sequence of  Variant No. 641 of  mature Human GLA
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMPNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 682 - protein, 398 aa, Artificial Sequence
  Synthetic Polypeptide sequence of  Variant No. 642 of  mature Human GLA
LDNGLARTPPMGWLHWERFMCNLDCQEEPDSCISEKLFMEMADRMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 683 - protein, 398 aa, Artificial Sequence
  Synthetic Polypeptide sequence of  Variant No. 643 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINSQEIGGPRSYTIPVASLGKGVACNPACFITQLLPVKRQLGFYNWTSRLKSHINPTGTVLLQLENTMQTSLKDLL

SEQ ID NO: 684 - protein, 398 aa, Artificial Sequence
  Synthetic Polypeptide sequence of  Variant No. 644 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMPVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 685 - protein, 398 aa, Artificial Sequence
  Synthetic Polypeptide sequence of  Variant No. 645 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWSLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 686 - protein, 398 aa, Artificial Sequence
  Synthetic Polypeptide sequence of  Variant No. 646 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCACFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 687 - protein, 398 aa, Artificial Sequence
  Synthetic Polypeptide sequence of  Variant No. 647 of  mature Human GLA
LDNGLARTPTMGWFHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 688 - skipped

SEQ ID NO: 689 - protein, 398 aa, Artificial Sequence
  Synthetic Polypeptide sequence of  Variant No. 649 of  mature Human GLA
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 690 - protein, 398 aa, Artificial Sequence
  Synthetic Polypeptide sequence of  Variant No. 650 of  mature Human GLA
LDNGLAHTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 691 - protein, 398 aa, Artificial Sequence
  Synthetic Polypeptide sequence of  Variant No. 651 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 692 - protein, 398 aa, Artificial Sequence
  Synthetic Polypeptide sequence of  Variant No. 652 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAGPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 693 - protein, 398 aa, Artificial Sequence
  Synthetic Polypeptide sequence of  Variant No. 653 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 694 - protein, 398 aa, Artificial Sequence
  Synthetic Polypeptide sequence of  Variant No. 654 of  mature Human GLA
LDNGLASTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 695 - protein, 398 aa, Artificial Sequence
  Synthetic Polypeptide sequence of  Variant No. 655 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAGPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 696 - protein, 398 aa, Artificial Sequence
  Synthetic Polypeptide sequence of  Variant No. 656 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 697 - protein, 398 aa, Artificial Sequence
  Synthetic Polypeptide sequence of  Variant No. 657 of  mature Human GLA
LDNGLARTPTMGWLHWERFMCNLDCQEEPDSCISEKLFMEMAERMVTEGWKDAGYEYLCIDDCWMATQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQNPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 698 - protein, 398 aa, Artificial Sequence
  Synthetic Polypeptide sequence of  Variant No. 658 of  mature Human GLA
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 699 - protein, 398 aa, Artificial Sequence
  Synthetic Polypeptide sequence of  Variant No. 659 of  mature Human GLA
LDNGLARTPTMGWLHWERFMCNLDCQEEPDSCISEKLFMEMAERMVTEGWKDAGYEYLCIDDCLMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 700 - protein, 398 aa, Artificial Sequence
  Synthetic Polypeptide sequence of  Variant No. 660 of  mature Human GLA
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 701 - protein, 398 aa, Artificial Sequence
  Synthetic Polypeptide sequence of  Variant No. 661 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHCRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 702 - protein, 398 aa, Artificial Sequence
  Synthetic Polypeptide sequence of  Variant No. 662 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLIIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 703 - protein, 398 aa, Artificial Sequence
  Synthetic Polypeptide sequence of  Variant No. 663 of  mature Human GLA
LDNGLARTPTMGWLHWERFMCNLDCQEEPDSCISEKLFMEMADRMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 704 - protein, 398 aa, Artificial Sequence
  Synthetic Polypeptide sequence of  Variant No. 664 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTHRELWAIMAGPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 705 - protein, 398 aa, Artificial Sequence
  Synthetic Polypeptide sequence of  Variant No. 665 of  mature Human GLA
LDNGLACTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 706 - protein, 398 aa, Artificial Sequence
  Synthetic Polypeptide sequence of  Variant No. 666 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGLGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 707 - protein, 398 aa, Artificial Sequence
  Synthetic Polypeptide sequence of  Variant No. 667 of  mature Human GLA
LDNGLARTPTMGWLHWERFMCNLDCQEEPGSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 708 - protein, 398 aa, Artificial Sequence
  Synthetic Polypeptide sequence of  Variant No. 668 of  mature Human GLA
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 709 - protein, 398 aa, Artificial Sequence
  Synthetic Polypeptide sequence of  Variant No. 669 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAASLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 710 - protein, 398 aa, Artificial Sequence
  Synthetic Polypeptide sequence of  Variant No. 670 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 711 - protein, 398 aa, Artificial Sequence
  Synthetic Polypeptide sequence of  Variant No. 671 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 712 - protein, 398 aa, Artificial Sequence
  Synthetic Polypeptide sequence of  Variant No. 672 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCYSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 713 - protein, 398 aa, Artificial Sequence
  Synthetic Polypeptide sequence of  Variant No. 673 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHIYPTGTVLLQLENTMQTSLKDLL

SEQ ID NO: 714 - protein, 398 aa, Artificial Sequence
  Synthetic Polypeptide sequence of  Variant No. 674 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDHDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 715 - protein, 398 aa, Artificial Sequence
  Synthetic Polypeptide sequence of  Variant No. 675 of  mature Human GLA
LDNGLARTPTMGWLHWERFMCNLDCQEEPDSCISEKLFMEMAERMVTEGWKDAGYEYLCIDDCWVAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 716 - protein, 398 aa, Artificial Sequence
  Synthetic Polypeptide sequence of  Variant No. 676 of  mature Human GLA
LDNGLARTPTMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 717 - protein, 398 aa, Artificial Sequence
  Synthetic Polypeptide sequence of  Variant No. 677 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQWALWAIMAAPLFMSNDLRAIDSQARALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 718 - protein, 398 aa, Artificial Sequence
  Synthetic Polypeptide sequence of  Variant No. 678 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQWALWGIMAAPLFMSNDLRAISPQARALLLDKDVIAINQDPLGKQGYQLRKGDNFEVWERPLSGDAWDVAIINRQEIGGPRSYTIPVASLGKGVACNPACFITQLLPVKRQLGFYNWTSRLKSHINPTGTVLLQLENTMQTSLKDLL

SEQ ID NO: 719 - protein, 398 aa, Artificial Sequence
  Synthetic Polypeptide sequence of  Variant No. 679 of  mature Human GLA
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 720 - protein, 398 aa, Artificial Sequence
  Synthetic Polypeptide sequence of  Variant No. 680 of  mature Human GLA
LDNGLARTPPMGWLHWERFMCNLDCQEEPDSCISEKLFEEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 721 - protein, 398 aa, Artificial Sequence
  Synthetic Polypeptide sequence of  Variant No. 681 of  mature Human GLA
LDNGLAPTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 722 - protein, 398 aa, Artificial Sequence
  Synthetic Polypeptide sequence of  Variant No. 682 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGYAWAVAIINRQEIGGPRSYTIPVASLGKGVACNPACFITQLLPVKRQLGFYNWTSRLKSHINPTGTVLLQLENTMQTSLKDLL

SEQ ID NO: 723 - protein, 398 aa, Artificial Sequence
  Synthetic Polypeptide sequence of  Variant No. 683 of  mature Human GLA
LDNGLARTPTMGWLHWERFMCNLDCQEEPDSCISEKLFEEMADRMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSPDQQVTQWALWAIMAAPLFMSNDLRAIDPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 724 - protein, 398 aa, Artificial Sequence
  Synthetic Polypeptide sequence of  Variant No. 684 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 725 - protein, 398 aa, Artificial Sequence
  Synthetic Polypeptide sequence of  Variant No. 685 of  mature Human GLA
LDNGLARTPTMGWLHWERFMCNLDCQEEPDSCISEKLFMEMADRMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQWALWGIMAAPLFMSNDLRAISPQAKALLQDKDVIAINQDPLGKQGYQLRKGDLFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 726 - protein, 398 aa, Artificial Sequence
  Synthetic Polypeptide sequence of  Variant No. 686 of  mature Human GLA
LDNGLARTPPMGWLHWGRFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 727 - protein, 398 aa, Artificial Sequence
  Synthetic Polypeptide sequence of  Variant No. 687 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINRDPLGKQGYQLRKGDNFEVWERPLSGDAWAVAIINRQEIGGPRSYTIPVASLGKGVACNPACFITQLLPVKRQLGFYNATSRLKSHINPTGTVLLQLENTMQTSLKDLL

SEQ ID NO: 728 - protein, 398 aa, Artificial Sequence
  Synthetic Polypeptide sequence of  Variant No. 688 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGQGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 729 - protein, 398 aa, Artificial Sequence; identical to SEQ ID NO: 710
  Synthetic Polypeptide sequence of  Variant No. 689 of  mature Human GLA

SEQ ID NO: 730 - protein, 398 aa, Artificial Sequence
  Synthetic Polypeptide sequence of  Variant No. 690 of  mature Human GLA
LDNGLARTPPMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHVSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALWAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 731 - protein, 398 aa, Artificial Sequence; identical to SEQ ID NO: 691
  Synthetic Polypeptide sequence of  Variant No. 691 of  mature Human GLA

SEQ ID NO: 732 - protein, 398 aa, Artificial Sequence
  Synthetic Polypeptide sequence of  Variant No. 692 of  mature Human GLA
LDNGLARTPTMGWLHWERFMCNLDCQEEPDSCISEKLFMEMAERMVTEGWKDAGYEYLCIDDCWMAPQRDSEGRLQADPQRFPHGIRQLANHVHSKGLKLGIYADVGNKTCAGFPGSFGYYDIDAQTFADWGVDLLKFDGCYCDSLENLADGYKHMSLALNRTGRPIVYSCEWPLYMWPFQKPNYTEIRQYCNHWRNFADIDDSWASIKSILDWTSRNQERIVDVAGPGGWNDPDMLVIGNFGLSWDQQVTQMALLAIMAAPLFMSNDLRAISPQAKALLQDKDVIAINQDPLGKQGYQLRKGDNFEVWERPLSGDAWAVAIINRQEIGGPRSYTIPVASLGKGVACNPACFITQLLPVKRQLGFYNWTSRLKSHINPTGTVLLQLENTMQTSLKDLL

SEQ ID NO: 733 - protein, 398 aa, Artificial Sequence; identical to SEQ ID NO: 724
  Synthetic Polypeptide sequence of  Variant No. 693 of  mature Human GLA

What is claimed is:

1. A recombinant alpha galactosidase A comprising an amino acid sequence comprising at least 95%, sequence identity to SEQ ID NO: 5, wherein said amino acid sequence comprises a mutation at positions 44 and 206, wherein said positions are numbered with reference to SEQ ID NO: 5.

2. The recombinant alpha galactosidase A of claim 1, wherein said recombinant alpha galactosidase A is a recombinant human alpha galactosidase A.

3. The recombinant alpha galactosidase A of claim 1, wherein said recombinant alpha galactosidase A exhibits at least one improved property selected from: i) increased thermostability; ii) enhanced catalytic activity; iii) increased tolerance to pH 7.4; iv) increased tolerance to pH 4.3; v) increased tolerance to serum; or vi) reduced immunogenicity; or a combination of any of i), ii), iii), iv), v), or vi), as compared to a reference alpha galactosidase A.

4. The recombinant alpha galactosidase A of claim 3, wherein said recombinant alpha galactosidase A is more thermostable than the alpha galactosidase A of SEQ ID NO:5.

5. The recombinant alpha galactosidase A of claim 3, wherein said recombinant alpha galactosidase A is more stable at pH 7.4 than the alpha galactosidase A of SEQ ID NO:5.

6. The recombinant alpha galactosidase A of claim 3, wherein said recombinant alpha galactosidase A is more stable at pH 4.3 than the alpha galactosidase A of SEQ ID NO:5.

7. The recombinant alpha galactosidase A of claim 3, wherein said recombinant alpha galactosidase A is more stable to exposure to serum than the alpha galactosidase A of SEQ ID NO:5.

8. The recombinant alpha galactosidase A of claim 3, wherein said recombinant alpha galactosidase A is less immunogenic than wild-type alpha galactosidase A.

9. The recombinant alpha galactosidase A of claim 1, wherein the amino acid sequence of said recombinant alpha galactosidase further comprises at least one mutation at a position selected from position 2, 7, 8, 10, 14, 15, 17, 20, 21, 23, 24, 30, 31, 34, 36, 37, 39, 40, 41, 43, 47, 48, 52, 53, 56, 59, 64, 65, 66, 67, 74, 76, 77, 80, 84, 87, 88, 91, 92, 93, 94, 95, 96, 100, 102, 105, 113, 120, 123, 124, 125, 130, 133, 136, 143, 144, 147, 155, 156, 158, 159, 160, 161, 162, 163, 165, 166, 167, 168, 169, 170, 174, 177, 178, 179, 180, 181, 182, 186, 187, 189, 190, 195, 198, 199, 208, 210, 217, 219, 221, 228, 230, 234, 237, 238, 246, 247, 249, 252, 253, 254, 255, 256, 257, 258, 259, 261, 262, 263, 266, 269, 270, 271, 273, 274, 276, 277, 281, 283, 284, 287, 290, 293, 295, 299, 301, 302, 303, 305, 308, 314, 316, 317, 319, 322, 325, 326, 337, 339, 343, 344, 345, 346, 348, 349, 350, 352, 353, 354, 359, 362, 365, 367, 368, 369, 371, 373, 374, 375, 376, 377, 384, 385, 386, 387, 388, 389, 390, 391, 392, 393, 394, 395, 396, 397, and 398, wherein the positions are numbered relative to the amino acid sequence set forth in SEQ ID NO: 5.

10. The recombinant alpha galactosidase A of claim 1, wherein said recombinant alpha galactosidase A is purified.

11. A composition comprising said recombinant alpha galactosidase A of claim 1.

12. A pharmaceutical composition for the treatment of Fabry disease, comprising the enzyme composition of claim 11, further comprising a pharmaceutically acceptable carrier and/or excipient.

13. The pharmaceutical composition of claim 12, wherein said composition is suitable for parenteral injection or infusion to a human.

* * * * *